United States Patent 12,180,497 (RESISTANCE GENES ASSOCIATED WITH DISEASE RESISTANCE IN SOYBEANS) - sequence listing, part 2

SEQ ID NO: 1 - DNA, 3814980 bp, Glycine canescens (residues 1,907,491-3,814,980 of 3,814,980)
gattaaatatactgataatgtctaatttatctaaaattagcttttacaccatcattatttataactaattatgattcaattgttagattgacaaaaattacatttagtagaaactattcattgctgttcatgcatcatgctacctgtaaatggggagattgtgaatttgtaaataggcccttgtggagtggtaatggtatgagctaatcttaaccattggataatggcttgaggttacatgatttcctaaaataaatacattactttgtcattaaatccctatcctgctgtctgaaatgttgaagatttagtctgactcataatagcccaatgctttctgtggagatgctattaccatgtaacccattcccacatgcatacctttctttttgggtttctgatttgtagaattcaacagggtagtgcagctgatgttgccatgtgtgctatgttgcaaatttccaagaataaacggttgaaggagcttgggtggaagttacttcttcaggtaatttagtgccccctaaatttcctttttttgtaaaaaaaataattctttctcgcttttattgtagtgtgtctgcaaattacaccttatctcacttgccattattctagagtcttgaatcaacaagcaattctatccattcttcctccctaagttgggagggggattggaggaatataagcattaatacgcaaacaagagcttggctgactcatattctataagcttactatgtaatcaataatttatgcatctgtcttctcaaaacattttctatggatcattggagaaattaagtgatgcctatgtagtccatcctttttttcttcttcttttcctgttgattattaatgacattatcttggttgtagttcttgttatcaaccaatgtaattgcagttacattacaacttgttccattggtgaattattccaccacaagaagtagttcgttttgccaactttttgaggcaatttccttaatctaaaagcaattaaacgatattagtaaccatatagttacaatttctatcaaccattatttttaatcagtatgttctgatattgaggttatttcaaatctgaatgtgttcagatatctattccaatcttgctgctttttcactaagattcttggatatgtcaaagcaggttcatgatgaagtcatattggaaggaccaacagaatcagctgaggttgcgaagtccatagttgttgagtgcatgtccaaacccttcaacggcaagaacattcttaaagttgacctctctgttgatgccaagtgtgctcaaaactggtactctgggaaatagtggtagactggtagtcccttatacagcatgaaaagccatgacaactgtttggagattttttctcattcagatatctttggctgcatggttcctttggtaattgcaatcaaaagatactgctactctggtgcctctattttcaaggcagaattggtatgccttaaatatcattatctgaggttgatttctatagaggtttttgacatcctaggaaattttccagtgttatgttttgataatataccaaagcataacacgttttgctttgaaggaagaaaaaggccaaaaccactggcctcggcgttttacttctctagttagcagttttttttgtttgtttgttttttttttgttttttttttgttttttttgcttctatattttgaatgtataccggtttttcatgccttgcatcatgtaccggtttgttgttttctcacttttctgaagatgcaaactatatcaatattgtatataaattattataaaaagaatctatctgcatttctgttgatctgttgcaaacatatacttctttgtagaaacatcatgcaatgataattggacgctcaaatagcactttgcatgcacaaatgatcagtatagccagtgacaattaaggttgacaactttcagtaatatcaagcagaattatgaatttatgatattctgtacaaatgaatttatgaatcttatgaacgagcgcaaaaatggcatacaagaatggaccatggacctactttaaccgttatgcatgcctggcaggagctaattaccttattattctttgatgaaaagtttgtcatttgatcatcatatataaaatctatgtagtgcaaactacgtaattgtcctctatttttgtgaaagagtaaactttcacttcccattccagtattttttatttatttacattttacatatcgtaagtgggttctattattaaacataattcatttttatttttcacaaactttcactttttcttgagtttaaataaaaaaaaatttaataataaataccattgaattaagaaagttaatgctagttaaaggcattccagtttccacccactatttttatgttcatgattaaaattattttcttcgtactgaattatgaatatttttggtggggaaaactaattttggcacacctaccacaatgatgtgaatcaaatcaaagcagtggacgtgcactccataatgagacgaggaaagtgtgtcaaaatgctggttggatatgacgttcttgaagaccttatgacacattgtattaagtatatttattgcgagaggaattttgtggagagttcaaaagtaaatttcaactgcataattatatataaatgaaaagttttttaaagtcataattactgaaattatataatttaaaaaaaaaaaactcacataatttatatgctttagttatttatgataaaatataagagttaatatattttttatataaaaagctttgtcacttcatacatttcctttatccaaaaatccaaatagaagtttcgttttcggttaatttcagtgcaaagtattgttttgggtctgtttccaagccgcaatttccaaacgtacggacttcggaaccatgcgcttgttgtatagggcatgtggtagggtttggaccttgaatggtgtggtgaatagaaaatgtaccatgtttggtttaataagtggaaagaaagaaagaaaaaatgattttttagttatttggtagaatataaagtgaaaagaaaggaaaataagttcatcttctctaatttaattgagtagaaaataagaaacaaagatatattataaaataatataaatacctttaaacggaaataaaccataataaaaaataataacataaatatgcttccaataatacaaaaaaaaactagtcaaggtacaagataaattaaacaataataataacctaaaaaaatcatcaacttaaataaaataaaacaaaactagcaatattttataattcaaggattttttttcttttaactcaaatttacacactcccattctttctaaattcgaaataatcaaattttggcatcaaattcaccaaaaccttaattttcttccttaattatgtacaaattaatcacaaaatactttctttctattctttttctttcttcattttttttcattattgacatccaatgattttttgcaaattattaaatgtaattactgacgaaagttgggtttagcataagcttctaatccctcacaatatgatgaaataatgtttgaattcttgttggaagaggtgcactatgaaattgtacattgaacaaattgtctctaaaagaggatatatgtgaaaaacaaaacaaaaacgtaattattaagttgttattacagtaataaaatccttttagtgatttagttgtaaagtaaattaaaataatgaatattattatagaaatcaattttcttaaaataaagaggagcaactcactctctagattccaacacattcttttttttattggccaaaatttatcgacaactacaaaattttgagtgaacttattaaataaagggtaagactcaaacaatttataatttccaataattttaattaataataaaaacgtgttagaaaaaatataaaaaagagaccgcgttaagaaaaagaataagggaaaatatgtaactagcaattaacattaataataataaaataaataaatttttatcataattaaaaattattctcgagagtcatagtgtggtatgttaaattctcttatttatttattatttgtgataaacttttattataatcttcaattatgaagagagaaaaaaacacaagtgtgttgaaatgtttattttgttttatgttaccattagaagaataataagttaccccattgaatattcttttaataaataatagttttataaaatgttctgataatttaaaaattactatcacgtaatttataaatttttattaaatctaaaattatgaacatgtgaataacattgtagtactacaatagagtggagcgtgtactttaggatgatggcaggtaagtaataagtcggatcctgtcgccttggccggtttgtgaccacgtgattcttgttttgcccaactgtgaactcatcagccccaatttctgactttttgcccttttctcttgggatctcaaagttaggttttagattatttttttagtaacagtttaattaataaagttataaattataatcaatctatatatcacaacttttagatggattctttttatataaaaattaaattgcatgatttgattttaacttataaaaaaacttaatttattttactttttaattttctttctcttatttcaaacatacaattttattacaattgtaatcagtaattgagtaattgaacataaatgaattattaatatgttcagattaaaattgaatcatagaactaagttcaatttttacagacaatttttatattagtccagtttccctttttcaataaaaagtgaagggttaagaaaaaaaaaatatgacatcattaattcatccatctacattactaacttattgtagcaaattattttagcagtttgtcttaaatcaagtaataaaagaaagatagtgctagagagtggcattccatttggaatttccacccagtattctatgttgatgattatgatttgatttctccataatgagtggtgaatatttggtgggaaagttaacttttccacgacgatgatgtttgtgagtcaaatcaacacagcattggatgcgcacgctacaaaataagacacagagcctgttcctcaaagttggttggattagatatgatatgatgatttttttctagaacagaggcagtttctcaaactcgttgcctccgaactttcaatttcactgaattttagctcaaaaagttagcaaaaaagttccctacctctgttgggtctgtttcaaatctgcaattttcatacgtgtggagccataagcttgctatgtgtacgatacccaactttgtttttcctttatttgatcttacctctctttgtggatctaaaatgttgcttctttcttctgcagtgttacttgttagaattagatttccacactttgaagtgaggcaatttgattgaatttgaagttaatgcctttttgttcaaacgaaatcattggttttctgtttgtgtatgtatgcttattttagtttgtcaaatttgatgattcttgcgtttgatttagcttgtcttttggtgaagctgtattccttttatccttctctggttctattaatgtgggtagtgttttagatttgattctgcttcatcccaaccattgtgatttggtagtgaatttttgctatgtgggttagttctttttctctccccttgtttccatgataaattattatagttgagttggcattctcatcctgaagtatcaagtgtggttgttgttgtctcatggcatacaaagagagagtacattgcactgtataaatacctgttttgttttgaaatcgtgatgcacagtctataatgtttttgaattatttcagaattgttgttctgctgttgttgatttgatgctggaactatgtttttgttagtgaatctagtaactctccaccccatccccctttctcttgaaaattatgacgcatatctctttatttctatagctaggctttgtgtggataaatttatctttaagtacttataggaaaaagaaataaaaaagtaaaatagatcgaacttttttcataaattaaaattaatttttgcactttaacttttatagaagctaatttctaggaaagttaaagtgtataaaatgattttattgtatgaaagaagttcaattcatttactttcatattttattttctataagtatttgtatagaaatttatccaaacatagtcttaatacatgaaagataaaccaaaccaaataatttgttagaaatttatgactttacatctcaaatcacagggtgacactaatttgtaagtgtaacagatcactgaataattctgctgggagcattcatctcaaagactggaacatttggatattgaattggaggtgttactaataggagcatggctcagagtctggaaggtataaaaggtggaggaggatccatcaagctaggcaccactggaacaatcagttccttaatgacaagggaattggttcacatctcttctgcatcaaagaagcaggtatcttcaacaagaagtaaaactcaaacacttcctgtttctgttccctgtggcagtacaacccaaaaaagactacaacaaagaaaatcatcagttgaagccggtagcagtggaagcagtaaaactacaaaccgtagaggacctggcaatggcatgccccagaaaacaaaaactaatggcagaaatacgcagagagtacccatgctaggttctgataaatgttcagtggtcagaactccagtgagggagaaaaatgataaaaagatacctaacattgttgaaattgtggacataaaatgtgggaatgcagaaaaggcttgggctacacctttggcaagtcgtcttaagaagctcggtttttcgaagctatccgagagcattatctagacctgaaatttttttgtgtcagacttcaggttcctgtaactgaaggctgaggtcccatttggcctaccactgtctgatacatccaccatagaacacatacttggtaaaagcttgctacttcctctctttttctttgtactttcttctactgtagatacaattgtggttgtagaacttgtactaatggatgaactcacctctgtgatttgggacttgttcctttgtgaattggaaccaattctgctgaagtactcaatttcttgcattatgagtgatgcaactgtgcctctggttcctatttctactgggggaaatttatccttatcttttgtgtcatttgagtcaagggtagtggatttatgcatgcttttgttggttggtgttggggagaaagcaaaatcttttgatttaagggtggtttgtgggtttgttctagaggggaaactgcagagactttgaggcatttcttttgttacaggagatgtggtttcacaagaatgcttcaccttatgttctatatctgaaactgaaatccatggcataggtctatgtagatagatgggagattggttgatgacatagtcactgcattcatgtgcttgcagttataacactctagtcctaactactgtgccacctttttaagtttcatcatgttcctaagtacatgctactagctaggtcgttatttgaaactctggatctgatgggattcatgtgaaaggtaaaagtaggacgatctcttccattggcttttttaagtaaattggtgttttagttggcaaggaatagtaggttaactaaatcaggaaagcaactatttatttgagtgcttttcaggttaagggaattgtggattattttggttggctccatctattttgtaattttgtttcatatggggttctgcaggagtgtgagaaagatgtaacattatttacgaatctatatctatcaatgagttaagttgctattttgaaataagccaaaaaccatgctattaggaaaaccaagatgcaggattcatgtatcttaatttgcatccacaaggtgtgagacaagtgactattagcttgaatcttttaaatacatgatagacatttaatttttgattatgagaaaaaacaagtattcgtgagtaaaggaattactctttaaatagtactctacttttttaaaagattagtcttatggcttttgattatgaaaacactctgaattaaattccgaatctaaaaaaattgttaatttgcaactatagtatttgtgttagctgaatcttcctttggtatatttaaatattatcttcgttatggaatccatttcttccctttattctacttatctgcataaatttattgccaccctactttactaccaaaaagagagagcaagtttgaggaacttgtgtcttactcttcaaaaactgccaatcctactggacccttgtcacgacctttgctttggtgtcactcacgggtagtccatttcacttcttggccatagatttcattccataaggtggaaaaacaaaatcgttataaccaaagctaaggagtgtctcattcacgaaaaggaccaggaccttactattttatccatatagtgtgcattttaagaatatactagttccttcaaaattatacctatctttttgttgaggagataaaaacaactataaataggtgaggccatcgggttctcaaatcggataatatgaaagttaaagccaagatgattaatcaagttcggtttaaattttaagtaatccgaacaaatttatttttgtttggttcaagtcattcaattactaatgtaattgtacaataataattattaagtgtgaaaagaatcaagaaaaaattctaatcatattcttttactcaattgaaacatcttaaatcaaaagcaataaaatcaataaaactttttttaagaaaaaaatcctctcgactttgcaaagtgttgtgcaacagaattctcctctttctaaatcttgtcataggccaagcataatgccttcatttacatcatcgtagtgatgaatgataatgcatataaccaaaataaaacttcttatgatcacaatattgtagaggaaatcaacattgaaacatattatggcagaagatgaggataaataaaaatgtagaaaaaaaattacatgatctagtcaatgtaatcaacgtctagaggcagttagaaagattctatttcttgtatagagaacaatataaaactcttaaaatgtgaacaacacctctatttttaccctgactcataacctaataaactggttcatattccaaaaaaaaaaaaaaaaacacaaaaatgagtttggtctacatcgtggaggctctgccctcctaccctctcatgaggctcatagtttcaaattttgagctccacacattgcgttacaacttgaattgtccccgttagcaaaatacatatcaacatttcttcaccttgacttcaaagggtctcaagctatttgcaatcattcaccaagtccaaattatacttgaacgtctcagtagacaaaggccttgacaacatatccattaattttcagcaatggctatctttccatggagaacaacttatctttaatatcatcttgagttactttcaacctaatatcaatatgttttgattattttttaaaatgatagattgatagataaaattcttggccaaattcaatgcacatttactatcacaataaagaatatggcttggaacatctacacccaagttatcaatatgaccctacaaccgtatacattctttaactccttatgttaaagacgtgtattctaccccgatggctgacaaagcaattgatcgtgagacatttatagcatttttttaactccttatgttaaagatttcgtatcaaatagtattattgtaactttagatgactttttttaggacttaattatagacgactttatgtagacagtcttagtgattttattattaattgacacttgtaatcatacacgtcaatattcgctttccggggggacaatgaatacattaaaaagggaatgttaaaacttaaaaagaaccaattccaaggggtactcgaaattgctttagtaaacattaacaatgattatgtaggtttgttttacgttactcctctccggtcccaaataaccgattatgtggtttaagcaagtccgagagggaaaacaacatttctagttacaaatgctgatttattttggtctgtatattgtatatgttcataaaatgagttttatatatgcactccaaaatgggtacaacttgtaagatacttaacgtaaaagttataagtggtgttattagtacgaaaactggcaatatgaattcatataaattttaaagtgaaacaatctaagtgttgcataaaaattcaggtacgcaagagagtgaaaaccgtccccagttaacttgttccgcaacacagattaaaaccttagtcaaatgttaatccctccgtcccgtgtcttatttgaagaaaaaaaaattatctcaaaataaatgttatatttaacttttcaatataatattaattatttttttttttcacaaatatcatccctaacaagtgtttttttattttttaatgtaatattaatcttaagattaattttgtaaaattattattttttatctatttaataacttttttgtatctgtataaaataaaacatagttactgcttaaaataaagctcaagaagcttcttcaaagtgtcaagcacacttgtgaaaggattaagcgcaataggggagttgagtcctagatcaggaaattggtttgtaagtgcctgctgcattccggacatagacatcatagctgccaactgactattggacattacttcacaatcctgaggtgtatctttaattttgcttggatcatatccatagtttgcaaggtaagacttgtacttctctataaattcaggtccagggttaggtgtccttgagtatatctgcgatatagatcacagggaaattaacactacaagcaaaatcaaatcatacacttacatcctaattaatagctattaattaaagaactgtatgatgcagtattgtttctttaatttatcttaataataaattagctttagatgtcatatatgccatcgttgaaaattcagaaaaagccttttgaagttcaataactacaaacttaagctatattttttagttcagtaaatacctgaataaaacttttatccttagctccggaaacaagagaaaaattgtcataatcagtagcaatcacatcataaggttccttgggaatgaatggcaatgtaggaaagcggagatagcatttttcttttatcatttcctgcttctctagctgtgtctcagttttctccaaatcttctgaaagacattgaacccttcccctaattccagttataaatccattagggcctccatgaacacaaaaggtatcaacttggatggatggtgcttccctatcaaacgtatatacaccctgaaatgtcatagtatgcccaaattagtatcaagaagcttgtcgaagccaaataaggtaaatgataaatcttatctccaagatgtactaactgttatactactgaatgacagaattatccacacatgcataataaataatgaacaaccttagggttctgtctgtgcctccaaattcaacaatttattatgaataatatgaagttgattagggaaagatgttgaaagagcataaatataatgggctttttctaaaccaaatgacgtcctctatatttactgctatatttattttagcatttacctgagtgcaatgacagtcttcttggccttgtcccgcaaatccacgtttaagtgaagcaacttcaaaccatcttcctgaatatcttacagggtcaaagtcctttgctgtcattcctctcatcatcattagatttgaacctttttcattctcaaatggtgaagtaactgcattctcactgggaccggcaagttggcatatattatttggtgcacgagatagatctgctgcaatagtctgttaatgaagtaaatgagtacacattagatcagctcattcatcataagaatatacatctattttctagatttttttatcaatcaacaatatccagcctttgtaagaactcaaatatgggaaaaattcaagagtgatacaaaatatctatgcgagtaaagtgatccacatcagaaagtaatggcatcagataatgcaaaataattaatatttaatagcaatggcttttgctttgggcaatgtccatgtaattatggagttataaaaaagattatgaaccactatagctaaagtctctatacactaccatcagcaaagttttaacaaacaacttgtgatcgcgatttcggccacagcatcaaggttttcagagtcactgcaactgaatcgcaatcgcaattgcaatttgcagccacatcagttgcatttgtctacaatttcccgcaacatcaaggatcgcgatgaaactacaatttaaaactttgctatcatgtatttgggaaaaaaaaatactgtgagaacgttaagtaggtcctcctgatgggtattggacatatcacatcttgaaattgcatgattaactgaaatttcaatagtaagtagtaacactcttggattgtggaatacagtacaaacctgatttgctggagaaataaatatcaaggaagcagcaagcccagataagacatgctttgtcagaaccttacttgggacttccaatgagaacttcaccaatgtccttcctgacactatcctgcattgtctgtaaacaaaatgccatccaatttgcacaacaacagaaagataaattacaaaaataaaaataaaaaatcatacgatcccaggttgagtgagtatcatgttttagcaacagagttgatatttaacagtatctacaaatgaagagacaaaaaaatgcacttagaatcccaatgaaagaggaggaccacaaagaaagaaaaaaaagaaaggagtctgcaatctaattcactaaaatttggttattacacgacaaaattctgggagtatataaaggaaattcattcaggaatgctgtgtatatgaatatggaaaagctacattacataaactgaaaattgaagtccaccaaaaataaaaggaaccgaaaattaaatgtaagaaaaaaacagaaaaaagagtctgcaacaaacgtgggaaaaaaaatcattgttaaaatacttggaattaggagaaaattctaaagggaaaatctaaggggtgttccagaatggaaaaacaaataaagggacataaacacaagttgagcaacaaaattagaacattaaatattgctaaagatgaaaatggggacatattagttggatttgttacctcggataagaagaagggtgaggtggaggaggtgatgctcgtagaagaagctctaccatgtctttgccttttcacttgtccacagttgcccattctgaactttctattctgcttggtttcactttcatgacaaaaatcctcttgaaacatcgtcgtccaaggtcccatgaatcaaactgggcctgtttgaactggacattcaaggcccaatctatgtacaaccactttaactaactaactgtattattcggttgaaggcttaaagctaactaacagttgatcctaacacctttcttctgaccaccaaatatagatgagtgttagcgcagaatattatctaacacacttttttctcatacactattttatcgattaattaaaaactttctttaaataaaaagtgaaaccaaaacaatttggtgttttctataaagttcaactaataataaaaatttagctagaaagagtgtaataacaagataaaatgaattgaacttctatataatctaaaatcaacttatgcaccataaattttatagaaattaaatgaaaaaacaaacttctatacaattaagtgtaaaagttaattttaacttttgaaagaacttgaatttattttatcttattttcttctcttataaataaatttattcaaataaaatcttaatatttacacattagtaaatgtgtgtaaggagtgttgaacaattaacatttatttatttatttaaattagaaaagaagtcagaaagcatttgctcagctagttgaaatatgagaacaattttgttatttttcttaattcataacattaataatataaaaaaaaaaacgtaggtttatttgtgtcgtgtgtttgctcatgcttgtatgtacgctcggcttgtaggacattaggaatagtgattgaattctaatttaagagaagtgattttttttccaattaattcctgattgcgttgttcattttgggtttataaggaaataataggcaggaacctcaactcatgaaaccgttttctttattggtggtgacgagaccaaagccaaaaaaataaatagtgggagagttaatggctaacgccaaatttagagaaaacatgtgaacaaattgagaagttctgggaataatttgttagatttggtcattttaattaggttatagacaacctttaaaaaaaactgtgtcaaaatgaggttttgctttattctgttttccataaagttactctcatccatgaattcgatcaagtgtattattccatttccacattaatcttatttaattaacaaccaaatgtcactttcagtgagtttggtaaactattttagttatctaataactttatgaatttatttgactaaagtatacgtgtttgatcaagaaatttatctcattagcttataacgtttatttattttctacttaaaataacgtaatttgtagcgtataatttaacataatattttcatttttatcattaatattttaataaaatttctcatatatagcttccttgttactatattaattcaatttatttttatttttaatacaatatttgatctgtaaataaaaaataataagagttcaacttcaacctaaaaacatgtatatttaaaactttttataacttccaattgattcatcaagtatttttgttaaacataactaattatcaaattatattaaaaccctacttattaagatttttttctcaaagcttattgtggactaaaactaatggaagaaaaagtctcttttaagctcaaaaatccctttgaggacgatagtgtttcagatattgacactcaatcgagtttatttgccataaaaaaaaattgagttttttcttcttctacgataattgtgaaacatacgtattacaagatataataaactattgagtaagtagaggagatccttgcaggattgtatacaggagattgtcattgtattaagaaataaagtcttgacatgcacatgctagtttttaggtcactgtattttattcaaataatttaaataataaatgtagaaacaaccaatattactatttcttttattatatccacgagtatatgtactatttaaaaaaacttaatttgaaaagaaaaacaattgttagaaaattaaataagttaaatttttatggttctatagttgattatttgagtgcttatattttaaaaaaaaaaaatcattctattaagtgtgtcttttgaggttcttctcaacaaatgaagtgtgcaagatttccaaattaaattgtataaagatgatatgcaaacccaccgaaagtatttcacgtacaatacacgcattattgaattttaggaagacaaaaatcccaacttttacaaaacccactttgaaactttaccaaacttccacgatcaaataacacaaaaatcaatttacaaaggaccccatcactcaattacaccgattacaggtcttgcaattaagcataattccaagtcgtgtgcatttcactttctttctgtttgtcaacacgtatgttcgtattctaggcatcaacatctaacgcaaactgtaaacctaattctagttagttgatcctgagttcaatttagtaaacctaattatcaacgacagtgttcgtagttacgtgtaagttagcgaaattaattatacttatatagtaattagcagtggttacatatatatactaatgtcagtttggtgagaaccttttcgttcatttcattacattatcctaactccatgatctatgtaactaacaaaataaattcatattaaaatatataaaatatattaaagatagataggttggtgggtttatataattaatcaataaaactttagctagataccttgctctagagtctaaacttttatagatggaccacattcaaaaaagggtagcatccctaagtaaagtataaggtcagtcatggatatagctaggttcatttagggcaacatttggaattacaaatattccacaataaattaatagcaaataggttttagatatgaagtggtgttctctatcttgggtcatcgaccagcgtgccacatttttttaaaaatattgtctaaatgtcacgcatacagtaaattttaccagactgtcacattgcctatttcgctatgcagtccagcgaaatatgtgaactgacgtgacgtaattctggtgaccacatattttgttacaggggccagcgaaatacatgatcaaaacgagcaggacacgtgacaaacatgaggtatttcgctggagagtccaacgaattacgtgtcaatagaaaaaaaaaaaatctcaaaacttcaaacggtcataacttttgatagaattgtccgatgaaggcgtacgatttgtcaaaacacttaaaattcagagaggaaaccctaggcaaagtccctaaggagatttgctccactattttttcttcttccaaaaaacgtctctaagtgcctcaaaattaggatttaagcgtacaatatatcctttaaatagtctaacttttaataaaaatattggatcgagacgtatgatatgtcaaaacactcaaaattaagaaaaataattttaaaaataaaaatagaattaaattaactaattaaataattaaaaaagtaaaaaaataataaattttttggatgattgaatcctaaatcctaattttgatgtgaactagcgatgaaataacaaaaaatctaacagcatatttggattagcgttaatatatactggatccatgtttatccaaagctgttacaagtagcttctgcgtcattttagtgtttatattaacgtgaaaatcttcctgtacgtggatctaaaaggcaccctaagccaacggaacttctctactttatttacaataaccccgataatttgttaggcatgccccattgctctgataatctattatttgtgctactatagtcgattatatgcacactaaaatttgttatgtatgcccccaataatgtattatgcgtagataatctattatgtcctgcaaattggatcctataactatctaatattcatatgtgagagtttagagtttatatacaatgatggaatagaatttttatatctaatctaattcctcttttcttcttctatccaaatcaaacagtttcataatatatttttttcttttacttttacttatcttggacctaattaagaatctaaaattttatctaatttcttatttattactcttatttctatttttttactatcctatttttatttactttacttcttttctcgctggtgtaagtaatgttatctacaaatctatagtataattttgagtaaatattacctgcaagtaataatattttaaaggagaatcatgcatggcaattgggagacccatatacatatagtatgtccacatctgatgtgtagttggttatttaatttgaattttataatgtatattttaaatttgaatcatacattttggtgtcagggaaaagataggaagattgcagagttgcagcagcctttttctttatcaaatgtagttttcacttttttgctctcagtgtgatcagtagattcagatccaccaatcagagcagcaatctgtaatttgtctaatcataccaacaaattgatggtatactgtacccacttccactaataataacacaaacccaaatataattagcggttctgtggctcccttaaattcctaatgtgaaaattagttaaatactataaatctagtagaatctaatcatggtctattcttcactttttaaattagtctgaaatcaacttaatcaaatgtaaacattttattttctttctttttaattaattttactattatcatttgtaattgactttagcaaaactaattcaaaagcgcgtttaacttcacatacattagacgtgtctaacatgctaaataaaattttttgtgttattaacatgctaaataacaaacgtttgcttcttttggtaaatattttattaaatactagacgtgtttaacatgttaaatattaaatgtttagtttttttagtagatattttgttaaatattagacgcgtttaagtttactactattattaaataacagtatatattttcataatttcatgctaaaatgtattaaactttaaaatataaaatatataatattttaataaaaaattctgcgctctttcaaattggtttttaatttataaaatatttaattcaaattaaagatataattatgttttatattttttttctttcaaaaaggataaatatgattagaatattaagtatgaacctctgatatttagaaactcttaaacagtgcagtcgtatttttattatttttttattttgagaagaacgtgaccattcactaacggttcaatcctttaatacatgtaatcattctcatcatgtcttcaattcaatttcaaactaatactagaatgctaataataatcagcaagaaatatcaaaataaaataatctccaactctttcagtcatgaatgttattatttaaagcacgggaattaaacaagaaattacgctacgtggtcacatcatgcgccctctccacagcagataactcctcatcacactcggtttttcaattcctatcctatatatcctcataagatgccgaatgcatcatgacaattgagaaagatacatatacttctctcataccacaccccataacactcttgttcgatttcttatacaagaaataaaatgataagagaagggataagtttgagataaaataacacaaatattcttgaacagccatgaacctttttgacatctaagagtggaagaaagaaaacagaaaaaaaaaagatataataaaaaatatgatgttataaaaaaataaaaaaataatgagtgctattttttcttacttttataaaaatatatttgtataaataatactacaactacaggttaaaggtgtgcaagaaaacactcagactgaatcgatcgagttgtaatcgaaccaattttcacctaaattattttttttaaaaaagaactatattattgtactaaagaggttcggttaacctaattgttaataaaccaattttcatccaattaaatcagtttttttctttttataaaaataaaacagtcctaaaactcgttcaaaattagttcaattcttaaaattgatttaaaactgattcaaaatcaattcaatttacaattaatttttaaaattaattcaattttcgaaccaattatttataataatttgactatttggatttttgaatcggttaaaacagtttagaataaatttggttcgatttttttttttttttgtaaggaataggtttttgcacaccccctactacaggttcatttaccatattacccatctctacgcagaaaccaagaaggcggcaatacggagagtttaggaaaccgaaatgaaaaataccggtcaactgtcccctatattaaacagtgggaccgagaaaccagactaatagaccaaacgcaccgcaacaagaagaacaacaaagaagaagattaggtactaactatctatctgttatgtgaatattcaccgagaagaaaccatgctcgatggcgaagaagatcattcacgacaccactaggaagatgtctcagctgtgccggaaaatcgttcaggtcgaagtccggtggggtgtcctcagaagggtatctttcgttggccactttttccgtttcatttggaacagacttcttgtttgctctgtcgccggaaggccatctcactaccggaaactagccctccgggacccctcttcttcgccgctggccaccgttgacgacgtcttctcctccgttgcaaccactactggcgactatgactccgattccgatttggtgaacctcaagatcagcttgttgggtgattgccatattggaaaaactacttttgtggtcagcatgtttctaactttaccatttcttttttgttttggtttttggaagaatttaacaagtgtgtactagaaatttaaaaacttttacatcattatcaacatggtatgacataattaacaaataaacaggaatcttaagcttgtattcaggcttcaatttcaggtctatgcatataagagactgtttttgtctccaaagattagtagataactctcaaccagaatactctcagcactcaatttttttatgtaatattaaaaaattacttttataaaattcttaagcttgtttatcatgagaattaacaaatttactatatatgagaaagtttgtgattagattctccctacatatattatttatttcttttgaaattggtcaagtgtagtagtcttttattttaacgggtctaattaactagcttgtggttatgtgaattcctattctcagatcaagtatgtggggaatgagcaagaaaagagaagcttacagatggaaggattgaatctaatggacaaaactttgtctgttcaaggagctcgtatttcgtttagaatatgggatgttgcaggttctttgcttaaactttacctttctttccctttatttttctctgttttgtctgtgtatactttttagttttcattctttttagtgttctgggtttgttggtttgagttaattgacttattgacggtgactttatattatgtggcgtgtgtaggagataaaaggtccttggatcaaattcccatggcttgtaaagatgcggttgcgattttgattatgttcgatctcaccagtcgttgtacactaaataggtaggctaagagatactattatctgtgtcatgagttaggtgaagggttcttacttcttagaaacgtaatggtagaaataatgatgatttgcgttttttgtactttgttatgttcgtgcagtgttgttcgatggtatagtgaagcaagacagtggaataaggtaccgtaaaaaataattttgcagggcttatatatagtactattacatgaattgattttatttcagaaagtgtctgccactgtttaaattaaagtgtagtttccaaaggcttttggcatggaaactctttttgtaaaacacgagagaaattttgaagtagcagtgcaaatggtttgagtatccacaggaaagtgacattaatttttttcattaagactggacagagaaatgaactctgattattgacttgccggggtatactattttttcaagatatcaaaatggcttgttaatataactaaatattctgttttaggctgataatatccaaattttgaagattttgacgtattttttatgaaatttctgatgacatttaatctgttcaatttgcagactgcaattccaattctaataggaaccaagtttgacgattttgttagacttcccccagatgtgcaatggacaattgtaacagaggtaaatcaatgaaataataacaattactgctgcaaattaggttttggtaacttaatttctcttaatcatagtacatatatggatgggggctgctttacttgccttggtcattttcacctattgactcgggaacaaagaataattcttctagtaataaataggagtcttatttggaacctcagcatgtgtcatttatgaaagttccatgtttccgcgtttaacattaactttggggcttacatgttgattaaagtcggatcagtgatgtgttcacagttcactactttcactttaaataaagttaatactacaactttttatcacattccttggtttttcaatgtttaacctggtacgtcacataaatacaggcaaggggatatgcaagggcgatgaaggcaacccttttcttttcaagtgcaacccacaacataaatgtcaacaaaattttcaagtttatcatggccaagctctttaacttaccatggacagtggaacgaaatttgaaacttggagaacccataattgacttctaaattgttctttacacactgattcgtatgtatatagcaggacaaaggagaataaaaaatagaatgagaaagaaagaaaacaagtcaactttttcatatatattggctgggacctatcaccattcaccacctagatacctaatttacatgtctcaatatataggccattttgactatacgtctttaggcttacccctgttgtggctgaggtcaaagcccacaggtcttgataattttatttctacgtgccctgataaaggagaaattctatttccatataacttttgtatgatattttttttattcatttaatgttactctctaacacattttcttttataattgttcaatatttctaagaaattatagtattacgagtgagaataactgaataaagagtaaaacctagatgaatgtgtaatgtgttgtttatatttgtcttgattttgaagtgatgtaatatctttgaatgtgatttatagtgatgcaattatgttgaatgtttttattgtaaaagcatatatatatatatatatatatatatatataaattttccttatttttttttgtcgttatatgaatcacttaaatttataatagtcgttaaatttaactaaatttaatgttcctgaattcatttaaggaaaagttaagttattgacattaatattatttttatatataattttaatattagatagtaatattttatttatgatataattttattttaaattaataattaagaatagaaattaaataataagttatatgtgattatattcaatctttttttttcaaatcttaaatactataataataataatttgattattattgttattaaaattaaaataatagtctatattatatatatatatatatatatatataacttcaattgaaatattaagaaccataatattaatattttgatttcataataatcgttaatctaatttaattatgtaaccttcattttaatatatttttacataaaaaacaaagcaatagtatcatgtcaactaaaagtagtttcatataatattcttagtttatattttaaaattttgatatttatctaatacatataaatttgacttgttaaaaagttcaaattttatttatttaatttttagaaagatatttattttcatcaaatgcaacagcatgtcatttaaaagaaattttaaatatcattttaatttacattttttttacattatgtaaaaaatataaatatattatatatttttaagaacttcattttttatttattttatatttattttcatctttaaaaagagaaagaaatgcgcaaagtaatatatattaattaaaggaacatttagttagccttcctcccgtgttcaataggaacccaatacacaattcctaagaaaagaaaacaagtactatgtcatagaaagctgatgtaaattgcgtatttttaagtaaccaccaaattcaataccctcatgtaattaaacttacgaaatctaaaaaatgaatacacagcttgatgaaatcagtgaaataaagtcttagcagcaaagagatgttataacatcatatcgactttgttgtcgagtttatacactaacatttaatgtagcacccagtcacacattcacaatactctcaaattaaaatattattactaatttattaacagattgatatctccaagtttcttgaagcccttggaactgtcaacaaaaattctgcatctttacggaatcgaggttccatggtcctaccagaatcatctttcaacatgtttatactaacccttttcaacatatccccattaccgatgaaatacatgagcacaaaaagttcattctcagttccacagaacccattaatctccaccacttccagacttgaactcaagcttgcataaactcccacgttgtccctccagaatcgcgtgcggttaaacagaaacggtgtttcataatcctaagtacattatatgtaacaaaaaattagcagctttttttatttttcaaatgaaaaaaccacacatataggcaaagcaaattttaaaaccacacatataggcaaagcaaattcaaaaacctaatatatataaaggataaacaaattcaatgtatgtgattgatactcacaaacaaatttttttcgaaacatagatcaatggtgagacactctaacatcgggcaactgttgaggaagaatgtgattcccaaaaactcgttcttgtccaaagccgtcttcaagatcaaatgttgcacaagcatgtcacttcgaaaacctagcagttcgggtccggtaggaataatcttatcgcatcacacacaaaaaaacgtcaattgaaaccatcaacaaatcattttgtaattagatatttcaattcagtgaaaaagaaatggaacaaattgatcaaaagagtggaactctgaaagttataattataaaagtagaatatatgataacgtacaattaagaaattaatatcaatagagaaaaggtgatgaagaatgtatacctgaagaacaaaactgcatacagtcaaaactctaacaatagatagattttccaccagattataaagaggatgaccaaatccttcgaagccatattcttgagagaaatcaatatttgcctcttccattgagtgtgaatgaatttccgtgatgaaaaagttcattaacccacagtactggaaaatttttagatctggtgcgttcactttgaaaacatcaaattcaaagcggcacttgtccaggacaagctttctaagacccttatgttgttcgtcgcctaggtcaaacttgtctgagttccaacaacttttaaaactcaaactctccagcatgttacaattggaaagcaaagctttgctagcactgagtctcacttccatccaacccaaagaaacttctttgagtgcatgaaagttaagcacttcagtctcaacaaaactacaagaatatagcttcaaagactcaaggctaccatgctggtaaactcgtgctggcaattgaaactgcgcctcgtcataattaccataataattttcattccagttcggatcagcaaagtcaagttccaactccttcaccccacgttctgtggcaaaagcagcgcattgatcaatgatctcaccagcatttctaggatttcataacctaaaagagaacttctccaccaaagttcctttgtgattttcaatccacaaattaatgaagtcaagaaaagtccttctttggatttctcttgtttcattaggttgatcaggtttaacaaaaaagagttcatcaaactctatgttttttgtgaacttgcaaacgttcaactccaaccatttcttcgagaggatagaagttctcacagcttccttgaagggaagaagtgaaacgatagttataagcaattccattggcaacgaatagatgctcattgccatggttctagctatatgatatggtgattgataataaagatgtggataagactattagggtactgaatttttcttcaaatattccaatgggattgaaatgtgtgtgtgaaatggccaatgagtgctaccttatatatgcaacagacgttgcttcagtgagaaaacaatgttgcatacttctatatggatttttgtattttttttttcttttctgtaaattccatgtatacgttgccgttattagaattttttttaggaaaacataaatatatatattaattaattactataatatattactgttggatttagaatgaaggcaacctttggtgaaaatgcataaaattttaatgggattgttttcttcatttgtgtttttcttttttgtagattgtatatatccattaattaatttcctcaagtcccacaatggtttccattgttttttttacggtcaatggtttccatggttagcaataaattttaagaaatatttgcaatcaattactttacatttgttatttgtatttcaaatatttttaatgaattcaacctacgtttacagtttttatatgttgcataaagtaaatgatcagtttttatataaattttgtgtgtgtattaattgaagaaagagagaatgtgagggcaaataaaagaagaaagagaaacaaataaatgtgaactagtgtaggatcattaatattttaagattaattaattagttgtacatgtattaattattttaagagtctaatttttaaatattaattgtttgtgtaaaaattctcatccaaataaaaattactctattcatttcaaaataaatctcagtctgtttttttattcttacacagacaaagaaagttaataaatagataaaaaaagagtagtaatttttttataaaaaaaaaatgttaatgagtatcctaagattaagaaagtaaaagaggataatatatattattggaaacagtgaaaaaagtgttttcctatgatatttaaatgcactccgcatgattttcaatataaattttcctatttttgatttcttaattagtgttcttagaatcacaaaattcattttataaaactaaacttattattaatgttatattgaaaagctaaattaaacttattaggagtattattgaaaaaaagtaattgatattaaattggaaagttaacataacactgattttaggataatatttatttttaaatataacacttattttgggatggaagaagttcaataaaattatttttggtctaagaattatttgatttaaaatttattttaatgttaaaacttaaaataagaatttcaaaaataaagaaaaaattgttggcttaatatgttttccatatgtgtaatattttccatttgtatttcactatctaaccttttttttttattacctgaaatattttatgtttgactttagtatcatttgtcagtcagactttgttaatattaaatataatattaattaaaaaattaatgctaattataaaagataaaatatttaaaaacttctatattatttttcaataatactatttttatatggtaaaaataataaacttaataatttttatattatttggaaagtaatttaataaatatatatttagaactttgaaacttaaacataaataaaaaaatttaaagataatttacaaatagtatattatatataatattaattaaaaaatcagtattagttataaaagataaaatatttaaaaacttctatattattttttaataatactatttttatatggtaaaaataatgtatttaaatcaaatttaagaatttaatatcatttgaaaaataatttaacatatataccattttaatttagaattttgaaacttaaccacaaattaaaatcttaagaaatattttggaatgtaaattaaatcaataacttctatatgactgatatgacataattacacttttaatcacttataattatgatacataaaatactagaaatataattaagacatgtcaatttgttttttaaataacatgttaaatgtcacttcatcgacatgtgcttatttagtgtcacataagaaaaatttattaaatattttaaaaaaagtatgaaaaaaagactaaaaatgcataattaattgtgacatttaaaagattcaattcacgcaactgtgccttcagagtccaaaatcactaaatcatgatatatctaatgtatcaaaaataaaattaagcctaaaaatgtctaagacttgatatatatatatatatatatatatatatatattataattagtagcatactagttataaagtttttactataatttaaatttaaaaaaagtaagccatagatgagaagtaccacttgctccctgacttaccccaagttaaaaacactttgcaaattctaccaagttagtatatcaattttgttttagattacactatctcaataaaaagaaaaaaaaattattatttctcttgccataaaagcaacaaacttggattctgtcttcatgattctttgtccttttgataaaatactacataacataaatctgcatagcttttagattgtgtctgtcaatatccacgcttgatatatattgatattagaatgcacataaatactaaattttagccttaaaagaatgaaaaatcttaagctgaaacacaattaaaagctattattgtaaaatgaattttttaaataacatatatatatatatatatatatatatatatgcatctaatgaaatctgtgaaatctaaataaaatgcgtttatataatatagacaaatgtcttgtattaataagtaacgtttgcaaactaaaaatgcataacaacaaagaccaggattagcacttaaacatataacatggtaagttgttttttttttttttgaataaaaagttgaaggttctataaaataatattaaagatagagtactttttcaagacattcaaacactttcttcaaaatgtaaattacatccgcaacccctagttttgcttaaatttcatcttatactctttcctttttgcacctacaaaaaatcttttaattgtttagctcacattacacccagaccccctccatcctaaacaccgtttaataatttaacagaaaataggcacatgctggtcatatgacttttaatgaaattttatgtttaaaataccctcatcttcttcctctcaacctgaaaatattttaagactcttattttttttctctaattaaatgtgaatccatctttttgttaaacgtgaatccaccttcttgatacgcagtattaaccctcttccttcttcttcttcaattttttagttcagtttttttctctgattgaatataatcatttgcttcaaatttagtattttgttcctacatttgtgttcttatggaaccaaacatcaacactattttaatcaataataataaacaaatgattttcagttcatcccaaatatcaatactattttagtcaataatgataaacaaatgattttaaatatcataagtggtcccaaactggtcctctatttaaaccccattcagaaatagacaacaataaacaatcaaaattaaataaatattcttaaaaagaatctatatacaaggttcaatagtcacttacaagcagaattctagtgtgaacagaaatcgtggaacataaagagaaacagaggaacagtggagaactcgcgtactggaagagaaacgatgaagaagtcatgaatggtgaagaggaatagaacgtgaacttcatgagaggaagaggaactcgcaccctgtggacattaaagaaaactcgccaacaagaggaagatgaatattacttgtgaataaggaaaatgaattaaaggtaaaccctaaattttgaaactaattgggaggggataattttaattttacaattaaaatataaggataatttcgtctgctcacatattttaattgatgttagttaactgcgttaacagaaggaggtaaaagtaatatgaaaaaagagagaggtatcaggtgaaatttgagtaaaatacaagggatacgagtgtaatttcctcaactatgtgttaaaagattgatatctctgagtttctgccatttgacggcaatgagactccacagtcttaccggaatcatccttcaacatgtttatgctactctttttcaagacaaatccacgaaagatcaaatacttgagcaagaggtgttcatttagagttcctctaaagccattaatttccaccacttctcgacttgaactcaatcattcacaaacatccaaatattcaatccagaattgtgtgctgttaaaataaaacggtggttcataatcctacaatatacaacagaaattagactccttttttgttaatagaaaataaccacaacatatattgatgtgttaaaagcaaattcaaaacttaacacacacacacatatatatgtatataggaaaaacaaattggatttacgtaattgatactcacaaacaactcattatgttgcaaggccatcttcatgatcacatgtacatccatgtcaggttccatacgttcgggaccagtaggaatcaccttaaaatatcacacacaatacgttaattaaaacaatttagataagatagatattgtaattaatccatatttcagttcatccaaacagaaatggagcacgtcaaaagagtgaaagttatcatggactataagcgtaactatacacttatacataattataaaactagtactaatatatgataacaattgacaaattaattatgagggaggaaaaggtgatgatcatgaagaatttagcacaaaactacttacagtcaaaactttagcagtacaaacatcttccacgaaactgtagataggataaccaaatccttcaaatgaatattctagagagaaatcaagatctatctcttccattgcgagtgaatcaatttctatgagctaggtcaaagttcatccacccgcaatacttgaaaattttgagatttgtttcagtaattgactttgaaataatcaaaatcaaagccgcattagtccaggacgagctttgtcagatccatgtgtttttctttacctaggtcaaacttgtctgaattccaacaccttttaaaactcaaactctccagcatgttacaattggaaagcaaagccttgatagcactgagtctcacttccatccaacccaaagaaatttgtttgagcacgagaattaaacactttagtctcaataaaactacatgaatatatatagcttcaaagactcaaggcttaaatgagtgtatcttatgtattttcctatcaaacatgtagtaaatacaagtgatttgacaaaatgaagaaacacccatgcctagaaatagcatataggaaaatattcaatttacacactttctttttcatacatctctttttcattttagttttatctctatttttcatcacatctatcactttatctctcttttttctttatttctctttcttccttccacctcatgccatctcttttttgggtttacatttatcaggttcacagcatacataagagtgattctttcaaatggaacttgttagttgtagtgaccatatagacatggacgctcaaacttttatgctactatctagattcaacgataagtaaatctaaacttaagtgtggtgatccaaaatataaacaaattaatcttaattaatttcactctatttaatggtattctttctaaaatattctttaattaatttagattttatttttaacaaccttatattattgcgatatgaatcgtatgactttcaaaatagagaaagtattatcattcgaaacaagttctcctaaaattgaagtatttcatcagtaagcatgaaaggtagtttaggaaatgaagttcattttttaaatgagattagtctcatattactaatctattatttgtcagtggcatatttctcactcaaaatttcataagctcctgatacaactttcactgagtctatgttagctcaatttgagacacagcaaaaaccaaagctacatacaagaatcacccaccccaaagtaatgattctcataaattgtctgatggtgtgaggtgaggtgagcaatcttcaagccattaaaaatattataaatacattagattatgtttcttcattaattctcaaaaaattgaccgaaatccaattattattagatggcctagagagagattgacagtgcatgaattaagtagtgcagaagtaagaattataaagttgatttggtggttgaaggaaaaaagatgttgtaagttcgaattcgctcactaacaaaaactaacgaataacatttatcgataaaaaaaaaaataggacagaagtataatcacggagcaacacggacacggggcagttaactgggcctccatctgctaatcaaaggttaatttaaagcaagaatgacccaaaaatataaattaaagctccagccagcatcttcactagtgttagcaagcattaatgggaatcataacgaccattataaacaagatcaccgtactttgattattattaagaaaaccttattataatatgccatgcatgtcttgagaaattatcctcagaccaaacaaatacagatgtttattcctcaaacttaatgataattcagaaatagaggggggcaaaaaactaataatctctaataataatgttccacagctgtgtcatcattattaattattatgtacaattaggcagacagccggatcaaccagtctttaccataatccagctaccacattccaaaactaacttccttatcggtgaccttgtatgaccacatgtaaagaagttcggggataattctcaattcctcaaccctactgatttgcctgcaaaaaatgagtagaatgagagattgtgtatacctgcaactaaaattgttgttttcaaaagaaaaccacattataagcaatccacatagtcagtactctgtttcttactttcttaccaccaatctttttcttgatatttcaaggccctccacaacaaactatatttaaaaagatactaaacatgtgaacaaatggattggtgcagtcaacttttgaagctttgatatgctaattcgtaataacatagatttagaaaaggaataaaaactatggtgggttcaaaccaatagcagttaggtcataggcggcaattcaaagtgaagctacttaataaaaatcagatcacctaatttagaatagctccatcactcaattctaacctatgactataaatctcaaatttttccttctagtgtacttacaaaatcaaattgttccaccaaatatcttttgaagtataattccaagacagtttgcacactagtattagacagtgtaggttcctccacctaatcacccaatgtctaacaacacaatctatgtcacccctgaagctagcctccaaaaccaacctaatacaacctttgaaaaggatcctccaaggctccaaccaataagaggtaagagtatgagcatgtatatggttcatttagtgcatgatatggccaaggggcacaatagttaacaataaaatatcactatagaaaattctcatctagataatacctgtgaatacaagaaggttccgaagatggcaatagcagctcctagagcattaataggctgaactggtgtgtggaagataatgattgaagaaactataacagatatacgtttcatggtgtttccaatgctaaatgtcaagggagagatctcatccagagacatgtatgacacttgattgtacagatgataaaatatgctctgagctgccacccacctgttgtgcacaagtagcagccatatgtttaatcataagacaaaacaatgcagaagattttcagaaccacaagtgaaaggacaagaatattagataactcaaaatcaaaaacaaaagaactcaggtcaatttcccgtttgaaaatccaaacacataaatcaggtttcacaccagcttcacggtcagcagcatatgtgtatgtgaaggtgagaactcttaatttttgtgagaaatgaaaacattggattacaactgttagattgaaataaactgttaattgcatatttaatttccaatctcacatgatctttgattaaaaaggaaaaaatcacgtgaggtttacaattaaataaacaatttgaactgaaaatttaaaatcaaatttttataatgaaatgtttgcatttctcaaaataaccaagaacaattaagatttaaaacaaaaatcatgcaactttttagtcatgctacttttatgtagcttttaatgttgatcatctatgactagttatacgaaaaaagatttgctctaatttctaataactacaaagcaactccataaacaatccaaccacttccaccttaccttctcctgctctgagatagtgtacacattacaaaaacaaatgaactaataatttgcgcaacatccaataaatttgaatttctgaaaaggacacaagatgccgacaataattgtcggaaaaaaaatattatgaatttatgacaatttcaagatatcacctttacagaaacatagcatagataacatcagatagagtagacattttgtaattaccatattatttggggtccaatttgagagagtgctgtttgccatccagctgcccacatctgtggtccctccacagcaatcgcaaatggtgtgagaattacaagggacaacatagataaacaaccatagtaattcattccactaatatcctttcccttcatgccctttttcgaatagatattacggagtacaaatgccaaatttgatatcatagcccccataaaacctgaaaaatataataaaacagtaatgaaatcaaaaccaggagggtgtgaaggactcctatgcagaaaagatgaaaagttatgtacattccatcataacctctgctaatggcataaacacccaagaatcttatataatagtaaatcatccattccgttggtggctcaacacaagcatgaacacataataattaaaatatatacatagaattccagtaataatcactttgcttgtggaggaagaaggggaagggtattgtgacattgccttaatcaataacttgccatcaaattatcttctctcgggtcaaattttttagttcaactcagattatcttctcatatccaacttttatactatgttcaacaacaaaatacaaaatagaacaaaattagataacaaatcatttttttgttagaaaagcaacttctttaccaatcatattgaaattgagctcagtcacagctgcaagagcacatccaccgatgattggaatcaaagacaggtagactggcgctgggaattcctcgcccattagtctggaaaccattacactgaaagcaggctcagcactcttaataatatgggtgaatgatacggcaacttttgacatgctaacagttgccgctacatgtcctattgtatgtaaaacagcaacctgcgggggaaaacagcaaacactaaggtcccaatccatatcaagatgttaataaacaaataaataaatagggggaaaagccaaaacgattcaagttcttaattaaattgcggtcacagacgcggtctaggtttcatcaggatctttgatattgcggcgaattgcagccacaaaggccacaaaagccttgacattgcggccaaaatcactgtcacaaacaattttctaaaacctttccaaaacttaaatttccatcgttaaaaaaaaaatctctctggtaaacctcctcccattcatcaacatagtttaaatgaattaacttttctctttctctttttcatgaaatcgtcaagcttccctgaagtcaaaccacacacacacacacacacacacacacagagatatatatatcaaaacatgggacaaaatagttcttaaaaaaaatgttttccccagaacaagtacacgtaaattataacaaatgaacaaacaaaaaagtatgctttcattttctcccatcaaatttatcctgaggaaacaaacaaaagtgagtcacttacagggaacaaattcttccagaactgaagatcagtcttaggaggctcaactatcttggtggcccaacagaacaacattatgagagagccacatgcaagggagagagttgaggtaagccaagggtatgggaatgcattcagcaccttcttgttataaatgttgaacaccacattcagtgcccaccatgttgcaaagtatatcccaatcttcaccttcttagcagcctctgatggagccccagcccctccaacctctgatctatcagcctcataagcctcacatgtcacgaaatcagcacgctcacgcctcaccagagacccaacgaaatctccaaaaccaacacgagaaaggtgcagtggcttttgcactgacaccaatgatctcagagagtttttttcccttgaagaaggtgaaacaagggaacatgactgaactggggttgaagctgaacactttttacgcaggaaaagatcagaacctctgatggatatggcgggttgtttcacggtgcaaatcatggtgtgcgatcacactgatgaaacgatgaaaaatatatttaaaaactaacaataaaaatctaaactttctgacgagaaccttaatgggttgctaaacaattgatgggagaataaaaaaacgagagaagaaagtagggatcccgtgcgaatgtgtcagtgtcagagccgtgatacgaactctcacggactgagcactattttttttatgtgatttgagaatgttgctgtgatgatttggctcaatgtgaatgtgatgcccctctgagatcctcagatgtttagtttagtgcaaatcgaagttactgcggcagaatccgataaacttactaggttgttaccttaatttagaaaagatcaagcataaaaatagaaaagatatggtaaactttttaaggatcgatgactaggaatctgttttgggagatgctgagacgaagggatatattgaatcaggatttttaaatatttttaaatagtataaataaacattttagattgaatcaggatttttaaatattttaaagtattataaataaactttttagattgaatcaggatttttaaatatttttaaataatataaataaactttttagaattcaattaagatggttaagatttttaaaaaaataataaattttagtgttaattaattatgattttttataatttataaaaagttttttgttaaaaaatacatataaattttgatagattatattttaagattttgacagatattatcataatttttaggataaaatatctatcaaaattttgatagattattttttaaaatttggatgaattttattgtactttttagtataaaatatttatcaaataatttcatccaaatttttaaaatttgatagattattttttaaaatttggatgaattttattgtactttttagtataaaatatttatcaaataatttcatccaaatttttaaaatttgataaattattttttaaaatttggatgaattttattgtactttttagtataaaatatttatcaaataatttcatccaaatttttaaaattctattggacttttttcttatttttttattgattaacatattttcttttctctcatcacacgtatttttttctctttttaatatttttaaagatgtgtgtatcatatgtttctcctattcttttgaaataaaaaaaatgttaattatatttttttttctctgcattttttcctttgttttctaattaaattaccatattatattcatcacttgttcaactcaatatttttgtgactgtcatctttaatttcatcatccacatacttagtaactctcttaccaatttttcactctaactactctcttatagtatatttttattattgcatcccatttaaatatatcattaaatttatcataaaataattttaatatttttaaaataataaaaaaccaaagtataattttaaatctacttttaaattcaaaagtgaaaataagaagatgttaatataagaagacataaaactaaaatcaatatagttattaaaaaattaaaaaatatattaattttacttttttatccaaacctcattatttcttattattttttcactaaactcttatgaatgtatttttaaaattttatagaatccttttaaatctaataaatctataaagttttttaaaaaaataaattcttatgatataaatctattaaaattcaaattatcataaaagtcttataaaaaaatctgataactcataatattcatatataatctttaaattttataaagatttttttatactaaaataatctcttaaaaatttaatccaataaaacccgaaatccactatcctataataaaaaaacatcttcttgcacacgtgtctccctctcattcactctcaaggctaaaatctgatgtgtcactctgaggttaattctcagcttcagcttcttttttcttttcttttttttttcctcacacaacacacacacactcggggctgagctcttctctcatcagaatgagaagattcaaaatttgaaaattttcaaaatttgaatgaaatacacaaaagctgtctatgagacagagtttgcagcctactgtgcctattatgtcacctcgccgagctatggagctgaccaccaagaagcaccatttttcaagcaaatgcattcctcagttcttccatttttcatatttttcacttcacctcagcgtcttccaccagtgtgtgacaatagctcttcacggtttgttcctcaggtcttgcatttctgatacttttcttgtctgtggtatgttattactttgggaatcaccattttctttaccttccttgcttctggtattttagcttttcagcttggttttggtaacttcttttagtcatatttggttttctttttttctttttgcctctgctatgttacttcttgaatcgcggttgaaaacactttcgttgctttcggtttttttttttttttttgccgtgcttgccatgttcaatgttgtaatgaagcaagatattggctgacttctttgtgtatcatctatcaaacatttgtaaaactcttattttgtatgtgggctaaacctcttatttgtttgtgtaacttctgtggtttgttattatgttgattttgttgagtgatatattttacttatgatgcttttttgattgtgttagtcagtatatcagaaaatcatccagtgtgttactttaacagttcagttgtttttgactttttctacttctattcgtctacatcttagtgaaactgtctttgttatcagcctataaaatgttgtacatctttgttaatggactcacatacttacttatttgtgtatgacccattaaacatacggttttttttttcaggtgtccgtaaaaatattaaataataccagacttttaatctggataatatctccattttcaacttggttattaatggctggcggtaagtttttaacatattaaacaacaaatatttttttctatgtccataaaattacccagttgttatttgtgtatttggttagtagtatttcgcaggttgaattctataggcgaaattaatgattccaaggaaacttggaagattgctattcgagtgataaacatgtggactatacctagatcacctaagtctacgactgagcttaaactaattgacaaggaggtaaggatatgttgtgtccataatttgtattatgaaggttaaataatgatatacaatattgtggtacttaagtgttgtttgtacagggtgatcagattgtagctcagatgaagaatgttgatgataaagtgcttaatgtcaattttgaaattggtcaaacatatgtgattcaaaactttaaggtggaaacaaacagtggttagtacaaggctacgcgacatgcttttaaattaaactttgtaaaagcaaccaaagctacgccccatgatttacctgaaataccaaacacaatgtacacattcacaatgtttgatgccattcataatggctctgccacacctgattatttaataggtaacctctgttgtaaaatttgtagtgcattattaacctttaattaatttggtggtttaacataatttggtttttcctttaagatgttattggtgaggtagttcaaatttgtcagtggaatcttgaaggacagcctaagaaagtgattttcacaatgaaggatgagtggtattgattattcaaattggtgttttacctcctgatatattctttatgaagtctgttatacattgtctttcgtattatagtttatgttattatgtgtctcaattgtgacacagtggtagtgaaattagttgtactttatgggaggcacttgctgtggaatttaaggagtattttgaaaaagcattgcctggaccattcatattaattctgactatggcaaaaataaaggaacctagaggtatgttaccttataagtaatacatgttcaatgtatgcttcaatgtagttaaacattaattttatacttcctgatttaatgcaggcaattatcctgtaggaattcagaattcaatgtatggatccaaaatatttgtagacaatgatatgaaggatattttggaattcaagaataggttggatttttattttggttaatattgttatcacatacattgttgtattttaacatatttgttatgattgaacaaattttttcagaatggatccaagtcagttaagcacttatacatgttcccaaataggaagtcaaatgtcaggttcttcaatctatgctgtggcagatcggtttctttataaagcttgtgtaaaatctttagatcaacttgcccaattaaaaaaggtttgataaaaatttcagagtctgttaactgcagtttgcataaactgatttatttattttgttgaaggatgatgtttgtgtcactgttgctactatatctaaattattggtagccaatggttggatttatgatgcatgccctaaatgcaacaaaaaggttaatgcacaagctgagccttttatttgtgttggatgtggtaatgaaagtggaaagacaatgccaaggttagtagattatatataatttataatgtgtccataaaatacaaatagcttgacataagtcagaaattcagttttgttttttgtaataggtttcgtatagatgtcagagtatctcagcctggtgaaactgctatttttacactttgggatcgagagtgtgttgctttgattcaagaaactgcagctgacatcaaagagaaaatgattactgaggttatgctggctatatctatcattttataggctaattttccttataattcattatattgtaatatattgtaattgattgtaaaacattgataattgtctttgcataggaagggcaatttgatccaagagatatcccggaagctcttgacaatatactgggcaaaacttgtgcctttcgattcaaagttgttccaggaaatacacgtcattctatctctcagttatctgaagataatggattaataaagtctgtgcttgccaaactatcaacgtctacccttccggtatatatatttgtatgtgtgtttgtgtatttattaaatttatgcactcaagaaaccagttagtaattaaatctttttgtttttatttaggatgatcgtcagccttccttgtcatcagcatcccaaactaatgatcttcttgatagtgcaagtgatttgatgttttttttttagtttcattgtttttacacacaccagtgattcctgtcgactaattcaattcattccatggttggcttgcagcaatgcttctcagcgactgctgagtctgatccaaatttattgtcttcaatgacaccagctaagcgtatttgtaccaatactgatagccaattggatggcattccatttgaagatttatcacaaatcgaactatcttgtactaggatgaaaaaacatatcaagcaggagtcatgatgatgacgtgttattgaagacttgtggggtttttttgtttcttaggaccattgtattaaatagtatgggtttattttggcactttttgatacatttgtgttgtaatacgatgtgatccagacattatttttgtctttaatacaatgtacttattttataattatatctgcaatatctgcaatgttcacgagtacaacatttccagcttcttcttcctttctcagtttgcttccagggttatgttaaacaacagtctataaacttggtattgtacattgtgtatgcaatttataaatttagctgagttgacatcaaagaataattattgaaggcattcattttatttacaccaattgaatcggagctgaatattatattttagtgttgtaaatataagaaagtcatatgtttatgcaccatgactacatgactttttcttccaggattatgccatagtggaccagtatttgacgtgaataatattttacaccagctgatacattatacattgtattctataatattcagctattagtcttgtggatggaaaattagaccaattaaaattaatatgatgttcacgaaaagaaaaacaaaattaagaaagtacaggacaaggtggctataacctggctagaagtaagatatactgtcatgaaccattaatttggtgtgactatagaatacaatcagaaaaagtaagttgccaatggttattgcaggcaatgtcaactgacaaatgaaagctatgagtgataatatgagtgataatgtctcatctcattaaatgtaacagtggaagcccaataacctaccttgtccttttggaaacactttaacctatattgaaactcacttttacaacgtatggcaaagaaatagaacattcataaaaaacaatgcagtttgcagacaaatttatgaagaagcaaaaaatgcaatgcactgttgacacaaatacatagtttctcaagcttttagttctctacagcttgccttccagatactcagaagcatttttacataatctgtccacatagatactgagttatttgatattgttgttgttagttgtggtcatcaataacaccgtaaatgatgggattcacatcagtttttgttaatggttgagctgagcagcattaatagctctggtaagtccaggtttttaacaatgtttggtgagccttactcaaatgaatagtaaaggtagatacttagcttttcaatattataaacctgctattaacggtcataaataaatgtatgttttggcaacatacatgacaatctgcattgtttaatattatttgttgtggtcagaaccactatatttaagtagggctatcaattaatgtcaaaaggtacacgcacttaaaagatattgaaccctcacgtattttttgtgcaggccaaccttactatttgaacaattgcacaaattgaaaatggaacaagaagttttgaaaagaaaggctgcggcaaaagtggcaagagtgaaacggaaatttattatccaacacaagcatttatcacaacagagtactgaaaacacaggtaccagtttaattaaactgaatatcaatataagttatttaacattgaagtaaccagcttcttaattgtggcagttattatttttaatataatgaatcactctctgactttttcagctcagctatcagatttgactaatgctgcaaatgctagattaaccagaaaacttatactgcaagcaaagaaattaccaacaagtaaccatagtaatggtaacagaattaacaaagtgaaggaaacaacaggtttaagatatgtacactgataggcagaacatctgtgaaatcatttgatttcatacattggtgttattagtgaaacactaatgataaaagattttatttttcaggtgctgttaattcacctggaacaataggtcgggaggtatgtagacagattccattagccgatatcagtaatactcaaccacagtcaactgagctcccaaacaaacgatacaaaactttggagaacacccgttcggtgcgagcgaatttgctcaatcaatttcatgttgcatcttcaacttctactgctaataaccataatcataaccatattcactgtattgtgtccgaacgcagagttgagccagaagagcaaatacttggtaggggtgaaatacttgatggatacttaatattcctttgtaaataaaattattaacaagacatgctcataactgaagtataggaatattatgcactatgcagaacacagtcataattgggttcaaaatgatgatggtgtatcacaagaaagccagaattctgatcagcagattagctcaggtttgtaccaactacaaataagtgttcaaaacatcaattttgacacgaggacgtattaaaccttcatatacattagaaatgttttaatacacatagtcaaaatttaagtatacggctattgcggattatgcagaacacaatcttaattgtgatgatgatgatcatgtgctatccgaagaaaggtataattgtaatgagcaaattagcacaggtctgtaactctattcacagttaaaatagttagacatgaactgtttttggttaaataactgttatggattatgttagactaatgttttatttcttattagaatatcttgatattggagacccaattagtacatgtacgtattgcaaagcttgtatgtggtatcaagaaagtaagacaaagactagaagcaaggctaatgctaaccacagcctttgttgcagcattgggaaggttcaacttcctttgctaaaagatccaccgttactcttaaaacagctactatatgatcacaatgaaccgcaaagcaagaattaccagaaaaatatcagggcttataatatgatgtttgcttttagctctcctggtgccaaaatagataacactttattgaaaggaaaaggtccacctatttatagagttcatggccaatcatgtcatttgattggaagcctattaccaatgcctggaaaacaaccaaagtttgctcaactatatatctacgacactgaaaatgaaatcaataacagaattggtgcaggaaggtaaatatagctattttttaaagtgcataatttgacattttgcaaaattttatctgaactcacagtatgttatcatgtttagatggcaagatactcttgatcgacaacttgtgtcaaagttaaaagatatgttggatgaacacaatgttcttgctaaatcttttaggatggcaaaagacagatttaacatttcacaagcacaaaatctaaatttgactctgatagcagataggaaaaaggatggaagaatttataacctgcctactgtttcagaagtggctgcacttatagttggtgatgcgactcaacctatcaatagagacataatacttgaaaaacaaagtggccgattacaaaggatcaatgagcttcatccatgttatcttgcattgcaatatcctttgctatttccgtatggtgaagatggatatcgtaatgatataaaatatagagttatgaacaattcaaatgaaagaaagagagacaaagtaactatcagacaattgttgtcttttaggctacagtccagaaatggtgaagcccaaaccttattaagatccaaaaggttatttcaacaatttattgttgatggctatacaatgatggaagcagaacgtttattgttcataagaactcatcaaaagcaactacgttgtgataaatacatcaggttgaagacttctcaagaagcccataacaatgtcactaccatttgtgggaagcgtattgttctaccttcatcttttgttggcagtcgtagatacatggatcagttatattttgatggaatggccatatgcagcactgttggctttccagatttgttcctcactttcacttgtaatccatattggcctgagatccaaagagtcctttcacctcttaagttaactgcagctgatcggccagatattgttacaagagtatttaaaatgaagctagaccaactaatgtctgaattgaaagataaaaaaattttaggcaatgttatagcatgtaagttctgcactcctaactcagacagtcctctctattgtaccattgttttgtaaatcagtttaaccatgttaactttcgttgcagatatttacacaattgaattccaaaaaagaggattgccacatgctcatatcttgctatttttagctgctgacagtaagtatccatgtcctgcagatattgataacatcatatcagctgagataccagatgctattgaacaaccacaattgtatgaatgtgtgaagaatcacatgatgcatggtccttgtggccaagctaacagaaactctccatgcatgaaagacggcaaatgcagtagattttttccaaaaaaatggcagcctcaaacaattgttgagcaagatggatatcctgtttatagaaggcgaaatgatggaaaacaaattgtaaaaaatcagatacctttagataacagatatgtagtgccatacaatccaactttgttgttgaaatttcgagctcacctcaacatagaatggtgcaatcagacgacatccatcaagtatttattcaaatacataaataaaggttatgatcgaataactgctgctgttgtacctgtacaaaatcaggatggtacaacagggcaatcggttgatgaagttaaacattatttggatggtaggtatatttctccttgtgaagcttgttggaggatattttcatttcaaattcacaaaagacttcctgctgtagaaaggttgtattttcatttacctggtgaaaatgcaatcatctttgaagatgatgatgacattcaagctttgttgtccaaaccaactgttaaggactcaatgtttacttcttggttacaagctaattcaattttcaatgaaggaaaagagctaacatatgcagaatttgtaagaaaatttacgtatgtcgctaaggaaagacagtggaagccacgaaaaaaaggctataccattggaaggcttaactgggtccctccaagttctggtgaactgttttatcttaggatgttgttgactgtgattaaaggacctaccacttatgaacaaattagaacagtcaatggtcaactttatccatcatttagagaagcttgctttgctatgggcttcttggacgatgacaaggaatatattgaggcattaaaagaagcataccagtggggctgtggacactttctaagaaagttgtttgttaccatgctgatatccaacagtatagagaggccagaacatgtgtggtctcaaacatgggagtatctaattgatggtcttttgcataatcaaagaaaaataacaaacattccaggtaaaaaacagtgaattttacagttctttatactattacagcatgtattgttaaatactttcgttaattatatttttttgcatttagatttacagttgtcagttgaagacatgaaaaatttagcattgctccagattgaacacatgttacagtcaaataagaaatcactaaaggattttccgtgcatgccttttccaagaggtgtagatcatccaaatgttgggaatcgatgtatttatgctgagcttaattttgacaagaatcagttgcgtctggattttgaagcatactttgcaagtttaacaggttaggcaactaaattttagatacaaagctattgacaattacattaatcattccaaatcaaactgcaattaacatttgtagaatgctgtctgatacagatgagcaaaggcaggtttttaattcaatcatgaatgctgtaactagacaggctggtgagttgttttttttatatgggtatggaggcactggcaaaacttttatctggaagacattagcctctgcattgcgttccaaaggacaaattgttttaactgttgcttcaagtggtatagcatcattgttattacctaatggcaaaactgcacattcaaagtttgctattcccgtgcctactttggaaaactccacttgtaatatccaccaaggcagtgaacttgctgaactattaaaggcaacacaattgataatttgggatgaggctcctatggcacacaagttttgctttgaagcattggataaatcaatgaaggacatcatgtctatatctgataccagtaatctaccatttggaggaaaggttgttgtttttggaggtgattttcggcaaatcttacctgttatacctagaggcagcagatcagacattgtgcatgctactattaatgcctcttatctgtgggatgattgcaaagtcttaaaactgacaaagaatatgcgattatatcagaactcagaaatagaaaatgctgaagaaattaaaagcttttctcagtggcttatagatgtgggtgatggaaaattaggcaaaggtgatgatggattttatcaaatagaaataccatctaattttctcattacagacttcaatgaccctattgaatccattgtcaaccatacctacccacagatcaggcagaattataacaatgaagattatctaagcagcagggctatattagcaacaaccattgaggttgtcgatcaattaaataagcatgttttgaacattattccaggtgatgaaataaaatatttaagttctgattccattgacataacagatgctgctgataatgaggcttaccataccattacaccagagtttctacattcgttgaaaacgtctggattacctaatcatagaatcatactaaaaataggcacacctatcatgttgattagaaaccttgatcaagcagaagggttgtgcaatggtacaagacttattgtgtctagaatggctactcatgttattgaagctcgaataatttctggtaaaaacattggcagtttggtgtatgttccacgaatgtcattatcaccatcccagtctccatggccattcaagattataagaagacaattcccaattatagtgtcatttgctatgaccatcaataaatcccaaggccaatcttttgaacgtgttggattgtaccttcctaatccagttttcagccatggccaactttatgttgcattctcaagagtcaaaagcaaaagtggattgaaaatactcattcacgacaaagaaggaaaagcacaaaatataactaccaatgtggttttcaaagaagtttttcaaaatctttggtatgtgctcatgtatatttccttttatacatttgatgtttgattttcagctattacaattaattaatttttccttggatgcagaatgtgtcttctattctattacttatcaccatcctcacctggacttggaacgttagtttataccaattgtgacattgttggtcctggaatgcagcattacacttccactctgtatatcaccaccatcatcaggagattatatcatgttaaattgtacgaacatgaaatgtacacaactattgctatcagctatgtaaattttattatactgcaaaaagtggcttctgtcatacacaattttttgggttaacacttaaatagaatgaactgacagtaagtttatgcctttttaaggacaccagcattacacctaacaggtgagaaagtggctcctgtcatatgtttatggtaactgtctaaacattttctgttcttatcgcagaccatgttaaaaatcaaaatcattcaacactttttcctctcagcaatttcatgtatgacactatttgctagccttttacacaattgttgaatccttgtcacaatgatgataacatctaagctattttttgcacattatgacatgtcctggtgtgaatcataattaagtaactatatataattctgagcacattcaaatgtttaataatcttcttgtcatcaaatgctaaaccttgagcctgctaccatttgcctgaagccctgaaccttatcccaatgcaacatttcggccttactacaccattcttagtggattatttttaccacctattttcctaaatcactctgtctaacaaacacatacctgtagcttcagacagcaaaccaaacccgatgtgaacacatcacaatcttaatataaattctaacctattttttaaaataaattccaagcctagcacaatagttgctatatacttgattcaatttgaaggctacataagttgttctcctcaaagctgtgttgtctcacctaattgattttgccttttttaaaaaatcttttattgagcataagacttaatattttgtaagaaacaccaaatcctttgttttctacatcatatgtgttgggcctttgactctagcaatatgcatacagcaaaacttttagaaaacaccataccgaattgcccaactctctaccatataacttttcattaacatgatcaactttaacagaataaaattcttttacaaattaatatctaataagtttaccaattttgcgatacacatatgaaatcaataatatgaaatttctctcttggactaagggaagaataactctaaaaaataactctacaactattcattcaccaccaaacgtcacaacctttcaccgcacttcacaacagttcacaaaaaccaatagacaaagttagtacctttatatatatttgaccgttaacatcaggacgttgaaacacggaaccaatttattgatatcaagatttaaattgccttttactttcaatcaatttgttcgtaactcaaattttttattgctaagaccctttcgctagacacggttatttgcaaaacagaagttatcaaatggttacaatcaaataaaaggtcatttgcaagcagccatcaggaggacgcttaccaagaagaagacacaaaaacactatctcagactcagtcaatctcatatccaaattcaacagccgttgttatcaacagttaagtatttttcattgtactcctcataacaccatttatcctttcttgtatacaaatgagaaccatattcactatcatgaataaattaaaattttttatgttgttcaacacaattttcatgatttgccttgcagctttgcatatttacttatacatgatattaaaacccatattgtgtctcagacccaagttttctttgttcgttgctaactaagattatgctgtggctatcatttgcttttcatatttcattttaagaataaaattacattttatatcaatttttgtatagtggttctttgtcatgctttttcaatgaaaatctgcaatagcacaggtggataaagattctacccagtatctcattttcatatgctatttatgttggttcattcgtaattttagacaaacttgctaacaaacattaggcatattaatctttactgcaaatggctatatcaaacctcattattttaaaaatatcttaacatatccagtcaaatttttattcgtaaatttacaatcacaatttcatatttctcatatacatttctgttactcaccaatctttgctgcaggatctaccaagtgaaatgtattactttttgcgtgattcaagtttcagacagattacttttgcaagaacaagagcatgcaaagttatattcgatcatcaccgcaaacgtgctaggattggttctggttggaaatctttggttactgatttcaacatcacaccagatatggaattgatcattgagttccctaatcctaatagcaaccgtggatgttggtttctttgttaaacacatcttttgtattcagcttatcttttgatgcttggaaaaagtatgtttctaacaatattttgtttatgtatgtaactaacaaccatctttttaacgatactttgtttatgtatatatttgtttatattttgtgtttactctataataactaagactattatattttataaattttcatatgttcttatacttaacttagtttcacaagaattagctatttcaatacatggatgttaatcttagttttaaaaattctaatattagttttaaaaatagtaacgaatgaaacgctacaattaaatactttcgatttcttaatggagtccttaatttattattagcttatatatttagcaatttatcttttacattttatttttaagtttgcttatacaaaaatccttaatcattaaacattaaaaatattttattcaaatctagcataacatggcggagcgaagcggagccgtcccgtgcgtatgcgcacgggtccaaaacaagttagatgataaaaacagtgggcttggtgaagtggtagagagagaatcgcagatacaggttttgctgctcccatcaaaagggtgaaacagtaaattcaatacttatagcatatttaaaaatatttacttcttaagtgaaatatgtgatatgtggactttcttagaaaaagtaatatgcacatatattcattaattatatagtttgttgcttcttattttcttttatttattttacgcataattactgttttaactccctaatttagggtcttatttttttaatttaaatttcgttttaggctcttgccaagctgagaataatagatcgataatttgtgatgatttttaggttccataatttgatttttaattttaagctaccaaagtttgcattttaaaattatcataatcatgaaaaggattaaaaatggcagttttcaaaattgaaagattaaaaagaaatttagaagactaaaacattttaatccccaagttgagagagtaaaataataatgaagtctttctttgtatatatcatatttcatattatcattataactaaaattaattctcctattttttctctcttatcaaataacataaaatatctatgcatcgttattttaacaaaaatgagcaaaaaataggatgaaatataataagatatagaagttaagtaaaaaggcataacatgattttttgttcagtattaatatgcatttaatgtatccttttatgtttttaatatcaacataatatttaacaagttgtaactaaatatatattttatcttcaaagttcaaaattcaaaaactatctttttctctcaataccagcttaaaatcacatgcgttatactgatattaaatttaaacttcataatgtgtaatttttatattattataaattttaagctatcattttttatatttcattaaaaataattttatattaccaatctattaatcaattaattaatttttttataattaacatagattggtacatttataattaacataattacaatcaataatcaattataagtaacatagattatatataatatattaattaataattataataataatttgataattaaattaatcaactaattatatagtgtttactaatcaattgtatatatgagattatgtaggacagtataataaatatttttatatattaataaaatttaattataatctactatatgaattagagtatgtaggacaatataatttaaaaattgaaacaaaaaacactcaaatcaaacaccatcttatcttatttttttcttatggttaattacaaatcattcattttgtcattaccttcattttgatgagttaagttgattgtaattgtaaatatactcaatgttattaaactcatatgaaacttagacaatctaattcataaacaacaataaaggagtagatagagagagagaaaaaaaataaggattttatgttggttcgatcaacgtaacctacactcaaagggagacaaaatatgaaactatataattttgcacaaataacatataaatagtcttatgttatatacaaacacatcaaatcgtaactaaccaaaaatactatcctctcaactaaccctgaagggtcttgaattatacgatcatttaccaaatccaatatatgcttgaacttttgattagaaaacaaagtcttagtcaacatatcaattggattgactgttgtggctatttctttatggaaaacaaattacatacactcacgaaattcactcagcatcataggttgattttttagctaaagtcaatgcactatgaatatctcaacaaaaaatatgtatttacatattcaaacccaaatcatgaataagatcttataatttcatacatttttttttgtgggacaaacaggtattcgagacttcttatttaatactcatctaactctcctcctcccatattagaccatattaggataaaataatatttttaattatgattcaatgtccaaatcgaaaatcaaattccagtgattaacgtatcttcttcaactccttttgttaatgacatatatacttcacttttttggtagacaaagcaagaataagttaaatcattgctctccaactaatagcacatctactatacatgtataaaaactaactgctagcaaaattacaaaattggacatcctatatttgtgacacttggcaaaaattagggacaaaatggtaattggacataaatttactaactgcacccctttttaataagtgcactccagtattcccaaattaaaacttgctaattgcacttcctattttataagtgcactcaaatattttcaaattagaacttgctaattgcatcccctttttgataaaaaaatctatatttctttcatccctctcgcacgttatctctttaacacatagacaatcgtataaatgaataagaataagtaacattaaaaaacttccttataaattccactctttagatattgtcttttattatccaatattagtatacataaaataattattgaactaaaacatatagttgttgatgtgaaaaaataggttatagaatataaataataacatgtctcaaagattatccttacatcttcattcaaaaacaacagaaatttgtttacactaaaacttaaaaaggaattatttggtcacatggtgtcaatgaaatttttggtcttaaagtagtatatttttctttgtattgcagatttgcatcactcttttaattttggatctaatcactttgttccccaatatacatttttcgatccccatttggcctcaggtaaatcacaacacaattgaataatggtgtccataataaattccacaaaattgtcaattatacatttttaaaaaaaatattttttcaaacaaaaaataaataatgtaaaaaaatcgttaactgataaatcctaattgaaatgtatttgtcaatgtaagaaattgataattgcaccccttcttaataagtgcactccaatatttttcaaattaaaactttctaattgcaccccctttttaataagtgtactccaatattttcaaattaaaacttgcaaattgtttccttttaaatcttaaatactcattatatcattttttcatccctctcacacgttatctctttaacgcgtaggcagtggtattacctgtatacgcagggataatttttctaaattaaaacttgataattgcacatccttttttataaacaaattaatatttccttttaaatcttaaattttaattatattatttctttcatccctctcacacgttatctctttaacgcgtaggtaatggtattacatttgtacatagggtatcgtactagccagttacaaaaatacaaaaatttaagtagaagatcaatgaaatgttcaataaaatgttcaatgaaatgttcaattgttaaatttgatacagaacctctatgaaagtgatcattaacacaaacagaagtgaataaaagtaatccagttgatggttaagtagaagatgaaggttcaaagttaagaaaaggtgtaagacaaatggagagaaatgaaggtattacttgggtaaattgaaagagaagacctaaacaggtggaaagtttagtagcaaaacattaattttgtataaaattttcagttattttctttaatttaagttcataagtgaaagttgcttgctacatattacaattcttgcttagattgaaaattagtatttttgttccaagctaatttttttactttttctatccatcttatatctttatcttatagtgattatatgaattaaaattctaacaagttctcaatcagccatacattagtcatattccactcaaattatttaaattttcaatctttttgaaattgttgtgacccatcaattacatttatagacaatattaacaaaattgtcaagaagtactacattacaaattgatcgtcaagtgtctacaattatattacattatatctatatacctatttttattaaataatctttctttatgacacattcaaaaggaatgctaacaaacacaattgaatataaaagatacatataaataagtattataattttcattagtgtgtttacttataattgtcatatctttatattacacacaacaaatataatttcttatttttattataaattcatcattttcttaatttctaaaatatttatatgtttacttattataaaaataggttttcaatttgaaacgaatcgaaacccagcaaatcgatacatcccgtgcgaacgcacgggttaccgactagttattcataaataatgaagataaaaagcatgtttgggaaactggtgaaagcccctcaaacgtaagttgagtccaatagtattagaggaattaatttacaaacctaggtttgggatctcctagcggagacctaaacatgcacataaaaagttatatttgaaagggttctgaaaaacaattataatgaataacttcctaaaaaagaaaaaaaaaatatataaaataatcacaaatggatgagaaaaataaaatataaaaagaccatactctatttatcttcatttaaagttaatatataaaggaaaactccctacactggtattcaatttgtgttaaaatataatttatcaacaaaagaaatataaacaagtaaaaaataattatctttatttaatcacaattatcctctaattaatatttttcttatctaatcataatttttatgctagtgtaaatgaaaagactccttttttatataaaaaaaaccacttttgggctctgggccttggcccgacttaattggatcttgcactgtataaaacagtgttagttgggttattctaaacgagtgtatggagtgaacaatattttccctcctccaaggtcccaatttttcttaaaccctaaaacactctcactgaagaagctgctgcagaagagaatttccatttttacaaaatgtcgatgtcgaagagttccaagatgcttcagtacatcaactaccgtatgcgtgtcaccattcaggacggtcgccagctcgtaggaaaattcatggccttcgaccgccacatgaacctcgtcctcggcgattgcgaggagttccgcaagcttcctccgcccaagggcaagaagcctgccgaaggcggcgaccgcgaggaccgccgtacgctcggcctcgtcctcctccgcggcgaggaggtcatctccatgaccgtcgagggccctcctccgccggaagagtcccgctccaaggcagtcggcgccgccgctctcgccggccctggtattggccgcgccgccggaagaggtatcccacccgctcccgtcgtccaggctcagccaggccttgccggccctgtccgcggtgtcggcggccctgcccctggcatgatgcagccgcagatctcgcgcccgccgcagctcaacgcacctccggtgtcgtatcccggcggtggaccgcctgtgatgaggcctccagggcagatgccggggcaattcgctcctcctcccatggcgaggggtccgccaccgccgatgccgcctgggcaatttgcaccgccgagacctggtggccctccgccacagttccaagttccgccgcagtatggacagagacccatggggcctcccccacctggacagatggtgagaggacctccggctccccctcgccccggaatgccggctccaccaccacctcgccctggcatgccaccgccacctggcagcggtgttccggtgtttggtcctcctcgccctggcatgcctcctcccccaaaccctccaaatcaacagcaacagtaatgggagagatgattggtaggtttgtatttgttgttttgttcaatcctctgtttatgtgtttgagtgtgtgtttgcagaattgagtgagtcagtgagtgtatgtgtgtgagtgtttgagtgtgcgtttgtaaaattgatttttaagttatttatgtttgattgattttactataatagctagtttgatgtaaaatttagtttaaatttttcaacatcaaagttttaaattgctgctgccatcgcattccttgatattgttggaatttgtggacaagtctgccacaattgtggccatggacatctcaaattaactttgaccttgcgacttaaatttcaaatttattttttatcacctctagtctgacaatgaccaaatttgtatcttttctaaaaccatggttgacaagaggcggaatcaatttgtttaccatccactgagcatccagacacagattctatgttttatgtgtatcttgcactcttcctttttgtgtgagagatagtgatgtctagaaggaaaattaaatggtaaattaggattaagatgagatcatgcattttgtaaggaaaaactaattttgttatcataaatctctcctttgtttttatttgtaagggtgttggagccgggtgggtggctattaataataccaactcaaatttatgtttgggcatgaagcaaattttaacatcaataccttttagtcaagtttctagactcattaggatagctatcgataattcgacatgattgtgacttttgagttgcagagtaaaattatagtatgctgtttgccataaacaattttggaatttacctttttatatactgttttaagagaagatatatatgtatattgtatgtgtttgtatacacatacgttcccacccttttgcctttccatcatgcatcatctttatttgtggccagataagtgctaagctggctttcttggtgttttattgttattcctgttggtaaatcatcaaggaaagataactttcctgcaaactagtataagctatttgcaaacgctaaccaaggaaattaaatgctaactgatccaaatggtggtaaggcaaatgtgtaattctttctgttccctttacctttgtaaaggagcatgctttagcatagttgtcaatagtgccaaatagtgttgctatcccgtgctcgcaaagtgttgtggctggagcattttacaaaaattgaatagctctgcagtcagtgttatcaatggtggatggctgaaatccaaatttctgctacataaacatgccattgcaccctatggtgctgccatagtgggcttcccttcacattgttgtctatggtggttggcaaaaaaaaagaaccgccatggcggccttggcgctgccaaaaacccatccttttctgggaacatatccagtatttctcagcattttctgtccagttggccatccccaacatctgcagcctctgctctgctctccatagtttatgatcatccctgagaattatgcggccatttaattccagcgaaatgtgacctttgctgccttgctttgttctgttcatatgttctgtttttcaatccctctaaaacaggtattatcttgtattctaactctcctcaaagtttatcctttaatctttttattctaattggttagaataaaagccatcccgcagttcagctatagtattttcagggtctgcctctcagccaatatttgggattgacaactatgagaactgcctattcttaatgttggcaaactcaagagtctatgtaaaaatcatgttatagtcatatatgagtctattttatagtcttggaacatccattgacttgatattggaactgataagagtttacttcataaaaaaacctatcatagattcatagtatccaaaaataatttaatagcatcaccataataaacattcatagttccgactttttttgccattgccctgaatatatgccccatgcctccaccctagatcagtcctattttcaagagtgttcatcctagtttcggtagctacagtgttgcttgatttgcatcatggtaatggatgagccgtgaactgtatgtttcaaatcaggccaaaaatgacaaaaagtaaattttgttacgtcaaaatactgtgttttgggaaaaatagatgtcacaggacagtagattttcaggctcttggacttgagaatttatacatgtctacccaatgctactcactagactgccttttggcgagaaattacatgactcaagcttgtggactgtcagattccctcatgaactagtgaatttatgcacgtctaataaattcttcttaaaaaaaaaaaacaatgtaactcaactggttttcttgacttgtgagtttgacaaccatttctatcatgttcaaattacttttcactgaatcaatgtatccattactgttgacatcttaattactgtccaatttatatatttattttattttaactaatgatttagcatggttgaggacattgcttctgtaaccagcattttagatgttagtggtctattgtctaaaatatatggtgatgatatggtcttctatttgatctatgaaatatatattttcctattgttttttgtggttattgtctcattgtggtctgtatttgtgtcccatccttgtctcattctatgacttgaattttaactgctctaatattatttagcttcgaaacatcaattttttgcgttccatattaaacttaatatagtagaattatgtaagattcttaacaagggatttatatggcttttctccatcatttcctgtgtattctgtctcacttgtgaaatcttttacctttgtcattgttggactgcattcttttagcacattcactgattatttgaaaattatcgtgattgctcttgattgagactgactgaattctgcttgcatatagtaatagagaacttcaaattattgtggcaggtttcttactgttaatctgaagatatggactccgagcttcttgcacgcaattcaatatccagcttgtacttgggaactgattgtcttgaatcactctcttcttagggattgtttttctgatgtcttgatgagaatgtgtaatgttagaagaacaactttaagtattggagggagttattctactaaaacctgagcattagacatacaagtcggctgtgtagattttcaggtgaaaaatgccggattgcatagacagcgttctgatttgagtgtaggacaagaccccccatatcatttgggttaatattacataattatgactttgctaatgtttctggatcattttattttttattttctgcagttatttgcgctttgtttttcttagtgtgtatataactatatatattgtggagacgcaaatgtaataggaagattaaccaggaactcggtggattattaaaaatcggtgatgttgacattctaacatatctagaagagagaaaaaagagaataaaaaatagatattttggtcttttaagtagtttgtatcgagtaataaatcataaaaaattatcccatccaataccacatttttttttccaaatcaaacaaaccccaagttaattgaattctaactagatattccacacagaaaatatacccctaaattcgcagtattcgttgcaattcctgggttaagaaatttttaaccaaaactatgaggattaaaagcaagacttaaattgcaaataaattaaattatgagcctaacattactatttttttaagtgatagatttatatatattttatgacaattttatgtatgcatatttaattggagccaataaaaatgtaaaatttattatgttgtcaataaattataaatcgccatataattgaaaacggtttatttgtgtgattagtattttaaaagtcataggattttatttgattgactaacgtctatatcaatcaatagtatattaaaattaattacttaaatcctctaaaaaaattaattaattaaaaatacacttataatatacttaaaattttccttgtgttgccaaccaattacagattgccatatcatattatttattataattttcaagtcaataaatattacttgttttaagttatcaatattacttaaaatgctatttagttattaatcaatacaactttttttttacaacaagagtaattaaaatatatttttttattttattttataaatggcgttccaccaagctagtttataattaagcacggcgtgaacggaaaaacaaaaccctttccgatcccatcgctttcttagtttctctccgtcttcaaatctagggttcctgcaattgtagttgccgttaccaccgtgaaccaccgcgaacgccaccaccggaatagttgccgccaatttcaggttcgttctctctctctctctctctctctctctctctcctcgttgtttgtatattgattggacgattgatattcttcgttggtaatgctgtgattgaaagaccgagaaggatagaagtgtgtttcaagaaattgagatgtaagcaaactagaataggataccgagccaaagatgttggaacagagaatgcttgaaaaaccattgatttattgttgcatcgtgttgagaatcaaagtaaagttgttttaatcattgggttcctctgggaatctttgccaattgacgatgaccttcgaccttgaaggatttcaattaacgtgtgagcgaaaaagtgaagttgtttattgtatactaatcaaaactttattcattagctatttaacgtggatgcttgctccaaagtactctgcttcttgttttctaatgctttaagaattttagcttttgttctaatgctgtttttgttgtgttcttttttgctttataacgtaatttcagctgtaaggaaacagtgtgtaggattactgataacgttttgtttgatctgaaatgtgacatccagattcgtgatgggaaaaaatgagtttctcacacctaaagcaattgccaaccgaatcaaagcaaaaggattgcagaagcttcggtggtattgccagatgtgtcagaagcagtgccgagatgagaatgggtttaaatgccattgcatgagtgaagggcaccagcgtcaaatgcagatttttggacaaaacccacacaggatagttgagggctattccgaagagtttgagaccacctttctggagcacatgaagcgcagtcaccgattcagccgtgtggcagccactgtagtttataacgaatacataaacgatagacaccacgttcatatgaactccactcagtgggctacgcttactgagtttgttaagtacttgggtcgaactggcaaatgtaaggttgaggaaacacccaagggatggttcattacatatatagatagagattcagaaacccttttcaaggagaggatgaagaataagagaatcaaggcagatatggtagatgaagaaaagcaagagaaggagatcaggagacagattgaaaaggctgagcaaatgatgcagccgactacttctgaggctgatcagccttctcaggttgagcctccgagggaactgaatatggaagatggaatcaagataggattttctcttgggtcatcatcagctaaacctgtggtcaaggaaaaacatgaggcgtcaagggtggtgtttgatgagggtgatgaagagaaatataatgaaaggaatcccagaaacaatttgaagaggaaagaaagtggaggtggaaaatctgctttggatgaaatgatgagggaagaagagaagaaaaaggaagaaattaatcggaaggattattggttgcatgagggaattgttgtcaagattatgagcaaagtcttggcagagaaggggtactacaagcaaaagggcgttgtccggaaggtaattgacaagtatgttggggaaatagaaatgcttgaaagcaagcatgtgctcagagttgatcaggcagagcttgaaactgtgattccacaagttggggggcgtgtaaaaatagtcaatggtgcatatcgaggatcaattgctaagctgttgggggtggatacagataatttttgtgctaaggtgcagattgagaaaggagcctatgatggcagagtacttaaagctgtggaatatgaggacatttgtaaagtaccctagtgagtttgatggaattaatgactcaatggttctgtttattacatgaattgtagtattcgttcttatgtttctttctctagcgtgtcatctttgtagcacaaatcatatcattatcttatattggatacaattcttggaaatttatatttctgactataattaggcccctaacgtgcaataaaagatggtggctgagaaggctgaaatatcatgttgcaggtgcaattagactacagttttattttgtagttttgtggcgagtaaagttgaattcttattcttgccctttgttttctgtttctttgaaggcttagtcaacaacaatcaagttttgattttaactgggagcctgggtggagtcaactacttgtatgaaatgacgccaatttattttatcataaatcatttttaataaacacaagttgcaggtgtcaaaagttaatctctgcttgccatataatgtttaattgaaatgcgattgaactctctgctcccttgtttgaaaaggctacatttttattaataacagacagaacaatatccaagcacaaggagtgtttaagttttgggacaaaattacttcaattgataaaaaattattccacaccagaacccctgcatcccacagcatataaaaaccacccatatctagtgcgttagagatgatgacattgcgttccataattatcattcaatccaactgtaaatgctcccaaagtcctattgcaatgaaacaccaaattggcacaaaccatatattgagtcagatattatgacatccatattttagtgcacacaaattggcataaacaatgcagcagccaaagttctgctattagtcacatgatgaatttcctacgcaaaggaacattaaaaatagatcgccaccgtacaccatgaatcaccttatgttggctgtgaagataatcagcatgagtagccacggggagcttcctcaaagaatcaagctagctaagaatattgattcatttgcttttctttctttttgttgagcaggagcaggggcattggagcaagagtgattcagagtacacacattggggattatgcaaatcttgcagcatctattaacaaatattatcaagaaaagaaaactttcacataggtggcctaagaaaactagaaaacttttctaaagaatcacaactcaaatctaaatccgcgtggaagtttttattaactaatttgataaagctgcaatatcagtgtcacacttttcgtttattggtaagttaaactgtttcacttgacactagctaaaggttaaaatattacacttcaaaaacaatttgtcacaagcatcacatcgcaggttttaataatttgtattgatcacaaagctgcaatcatcgtttccattttttagtgtctgtttaagtagtttgcttctattctgcattttgacttaatggtctcagttgcttccttcttaatgctcacaacaaatgttaggcttctacagttttgtctcgagtggttaaatttgattatttgaatttggaagcacagatatttataccataaaacaagccacgttccagtatttacccctctagaacataaaggctttgatctttggaaatgaaaatatggttatgaatttctttctattctattattattattattattattatttactacttactagctagtgtttggttgttttagaatttttgatagaattgattttgaattgttaaacaagtatatctaaattaaagtacttttatactgttattttatcacaaatcattaggatgagtttattgatttttactataactatcttgaaagtcgtgcttagccattaaaatgattatctttagttacagattttatattaaaactcatgtaacgtgtgagatagatttgtagtgacaatcaaataagcacttactctatgtcagcagtgtattctgtgatattctgttcaatgcatataggtatatagaattgcacagcttcgatgtctttgtactctgctttatttcttgtcttagttactctatactttggccattcattcagagaacaactttcacccaaaaaaaattcagagaaaaactgttcagaattcaaacctgtagccacggacaggcacagaggggttatcttgtttgtaaaattttccatatatatagtacgaattgtttctgcacgaatgagacaaccaggtgggagatattttcattggtttttaataaaataaaggaaaataataattatggagaataaaacatgatattaattaagaaagagtatgcttgtatttttgttttaaagtaaaaaaaaaaaacctactaattttatttattgttatttattttaaaattttcatagtaaactatgtaattatatttaaggtccataattttttaatgaaaacaaaaagaaattaaacatacactatataaatgataaaaataatttctttaactaataaactgatatttaatttataacttacttagtattaaagtgacacgcaataaaaaatcatcttctattacattttttttcattttatattatattattttaatttttatgggtaattataaatttttgtaaggttttaaaaataaatattaaataataatgataataataaaacaatgccaatcaagggtacctaaaattctaaaaaagaagtactacagactacagtagtctcaaactgatattttgggtccaggtgctatggtggcatctgactgacattatcttcagttcactaagatatttagatttaatgggccccactaatgtgattttcttaaaaatatcttccattcagttgtgactccctctgcttatattttgatactctgatgctggtgccatcctgcattatctttttagctcaaatttttgtgaagcatttttattggtagaaatggagagtgagcccgtgaagcgcagaattcacatgattgctgctcactttgcacccaatgatgatatttcaactaccaacgttctgcctatggtaacatattatgttcttttacttatttgttcatggctggttcatggttcactagataatgatggaaaataaaggaattcatttgaattcagttatgtttttctcgacacatgggaattatttgggagttagatatagctaagtggggaaattgaacttatgtttctcatcttgtgctaactggcccttgttctccttttcatgtgaacagaaaaaaccatctaataggaatcttcatttattgtcatcgtaggacaatcaaactgcatataatttgagtattgtataaagtggactagcacttcattttttagtggctaaaggatgaaagtagctcgactgctcattggttttgaatacgagaaaatatgccctttcatctcatacagctagctttgaataaattgggaaatatcacctattcagtgtctgattttctatatatagtttaaccccgttgatattgcatatttgcgttaaattaggagacgtattagcttgtacagttgatgtcactatttattatgctaaagtgtttattgatcttgatgttcagcattggaaatttaattgtttaagttgcccttttcttttatgattggcttaggcaataataacttgaacactcttatcaaatcaatgcatttttgtaggctacaagcaacttcaaagtttttaaacttaagtgtttccttcatctttgtccctttttgatatttaaaagtgtttccgtaattcagaatttccatgtgctacacctttattatatgtttttagtagaccattaatttggttttatagcttttgttttacaatgtctaataaattaatctgtacgtactatcctttttttttcttgaatatttgtttgtaattcattttgttcatcaattttcctaccgctatcagaactgcagtggcagtctgaactctgtactccggagatgtgataataaggtgtattttgcacgccaagcttcttcttctcttggttattttatgaggcagacttcaattgaagaggtacttaagtgttcttattattgaaatacttaacagtgttcgatttactttttttgggtaagtgattcatttctcactggcttatttaatacaaatacactaactttcagggtggctcaacttcctttattgctcctaaaacaaatcatggtgctactgcatctgattgtctttctaatgcaagagcaccatgttttgctagacctgcaagggcagaatcagttttcacaaattcagtggtccaaccaatggctcaggagcagggctgtgattttagtacacttgatcctcctacatttgctaggccaaccagacagattagaggagatcagttacattctgaaaagaaaacgtgctattctgaaattggtggttagaactttgaactcggaaaggcatttgaagtaataatagttgaatagctataagaaacagatcgaagtatattattttgagtttaatttatatgcattgttagtgtaaatttttttatattgtcaacatataagaaataattattaatttgatttttaaggtaatattgtaaaagttaacaaatcacttgtgattgaacgaacatgaaaaaaccaatcacaaaccagtgcatagactatgtactctgtaatttttgtgacctttgttttttgcaggaattgagtggtctccaaggatggatgttgcagaatcagaaggcaaatatgttatcacagtggaagttccaggtgtcagtatcagtgacataagagtggaggttgatgaacaaaagtaagaagaatctctaatatacacccgcatattaattgtaatactctttgcaatttgtggtattaagcatttagttctccctaatcaatagaaaagggagtggtgaaggaaaagataaggcaaaacaaaatattgttggatgctctacttttgtctatgtcattattgtgtttgagtttttctttcatttgtgtaccgggggagggtcttgtctattaatacaaactttatacattatttctgcattgtaatataaagcataaattctggaagtgaaacgctaaatgtaaattttaatgttggacattcgtgatcatagagctttcgtagtataggacctcctttctttgtgataaaagagccaatgtgtgaactgtgacaggttgtgtgttaaaggtagacgctctactagcttttggacagttgcaggttgtccaaatgcttccttttcttcatatcatcggagggaaatactatatggaccatatggggtggtctggccacttcctgcgggtgtgaacaaggacagaatatcagctgaatttttgtaagttatatcttagtgttatgcacgtgtctcttgattatagcctcatattttaactccattctcaaactatatatatatatatatatatatatatatatatatatatatataaaacctcatctaatttggtctattgcattatttaattttttagtaactttggtttctggctcagtcacaggactctcaaatgattatattactaacaaagttcaaactggaagtagtaataaaatacctaggtacctaacatacattaggaagattttggctgcaagcgatcacactgctaagccaacaataccaggctagtcattagtgatctcttttactaacacaaaatggagagtcaaattgtaaccttgaagttcaattgagttcactgagaaatttattggatatttaatgttctgttaggctaaaatagctgattcactattgctgcaactagctactgtaatgatggccatcacttttatactgttttggtacttagatcattatggtattttaaatacaaaaaaaaaaaaaaaaaaaaaaactgaatctatgccaatcctaatgctttgtttggcagctagaatactgccatgatgattcataaaattttcaactcaatgtaaaagctatataatttatcacatctactcaaggggaactctttcccctacctctctcctctattctgctctgctgaaaactgaaaagttttccccatatagcttaaaataagtgtactttttttgttttgttttggtttactgaatttgtatgtgacttcatatcattttattttaaaaaatatgcatgcatggggtcgaaagtgacttgaataatttcagggactagtatgtgatgtgtgtggttttgcacaagttcaaagatatgtgctgtacctataaacatttgaagctgataatttgttgtttctttccccattttcagggatggatttctacaaattatagttcctaaagtttgagtatgactgagcaatattgatttgtagcacatatatgtatacgtatacctataccccgtgcatatagatggagaagaaatgggcattgttctgcatgagccatgtcatgccgtatatatatttgtaatgtaatgagcagatgatgggttaattttgatttcatatacaacttaaattgttgtgcagaaaatgtcctgatgcatcgtgagatgttcattctacgttccacttttgaaatctaatttattaagtcattaatacaccataccgtacaaaatgatacatagaacattgagggatgaatctctgtaggagatgattaaactaatcacatggttgaagtcgacttccaagtatcaatcatatttgataatttcaaacaggtctctatgctctcatgcttctatctgaaagggggtatgattctgaaactcacaaagttagtatttattatttatataaaagaaaaaagaaagtgttgaaaatatctaattaagagaatgatgaattttagtttataatataaataagaataaattcttctataatttgatgtcggtgtcactgccatagccaatgacaatatttattccttcaacgttcaaagtgggagagagcaattgcaacagcaccgatcatgcttattgctcactatttaggatgatgattgggtttagtttagtaggatcatgtagtctttattcatcagatttctttatttttaattaaaattacattgtagtgtttctcataatattatatcatccaaaattgtttaatgggtgacaattttataattattagtcgagataacttagataagtgatgtctcatttgatatcatgtgatggtccaacctattatagacacactcacatcataaattcaaattaaacaaccaatattcacaaactaaaataacaatgtataaatattttcttcataaatttatataaatgataaaaaaattaatccaataattaaaaattaacaatccactaaatttttaattgtgaaaagaagggtcgataaaaagggtaaaattaatcctaaacctaaagtgcaaaaaatcatcatcaatttcatattattaactgtagaacgttaactttaacgtaacgtcccacttcaaataatctttgaatctttaatgttaacttgatcttcaaaaattataatttaatattaaaataatccttaaacattataacttaataatatcagtccacaaaatagatatataaattaaaattaatgttctacacaacaatatgatattttttacacactttttttatattttcatgaactatttcaaaaaaattgtttttccaggaattaaattatcacccccttatattttaagggactatagtggttacccgtcctttaaaaaagaagatgtaagggaaaggtagggtattatagtttagtatatttcaaagaaaataagttctgatcttaaataaaagagatgtgaaaataacatgggccatgagaattctaaattaccttattgggcctcgacttataaaccaggtccataacatattgtaaacgacattctcgcagcttcgtctgcaaatgaactataactttacaatccgtcaatttacatcctctgtaaagtattaacaatttttttttatcccattattaatacgaaatatctattaattttatagataattaatctacgttaaaaaatttgatcaatcatcttttagtgaattttttttctctcaatcatatttttttattcataaaactcaaatccaaaatcttacttaaaataacataattcaaattcagtgtcatttgaactattggataaagaaaatcttataaccattgttctgcatttatgcttaaacgagaaagtggatggatgaggagttcttttttttcccattttttttattgatgagctctatccataatttaaaaccaatatgttagcttagattaattaaaatattatcactcaaacaataatcatcatactcaataagttggatcaggcctgccaaattgattagaaatgaattgactcgcttatcctatattttatataacattacttatttaaaaaaacaaaataaaataaaattagtactgctgataaaaaaaaaaaattcattaataatgcataaacataaactgtctttttaatttcaccatttcaattaactttaatttaatattatatttaggggtgttcgcgggtcggtttggatcgattttgatcaaatttaggacccaacctaatcaaatttgatcggttcagttttagaaaaaaaattgaaacacaatccaacccgctcatgatcggttcgattcggttcaatgggttacccattttaatttattttcttagaactactattttatatcatgattctttcaaatattcaatacaattaacacaatattatcaaatatatgaaagtagtaaattgattcatttaataccatcaacataatattctaaaatagacttataatataaattaaaacaaaagattcttgaacaagatttaatataatagtctgattcacaactatttcttacaaattgaactttgctataaccaaaattgttgtaaccagatttgctgaaacaaacaaatgaacagaaaatgattcattaatattataaacacgataaacaaaatatgaaaaaaaggtgaaacaaataacaatatacttgaaagtaatacattaagaagtttcaacacttgcagtttcaacacttggagacccaatattagcagtatttgaagtcaaaccaaacaactctaaaaatttaaacacaaccccgttagcacaaaaaataattgatatttatacaaatataaaaaatgaaataagagattacacacttgaatcaatcttttccgcttcatttatttcaatttgcaagtcattaatattttgcttagtaaatctaagccaattttggacacaaataagagtttcaacagtagtaggactcaaggaactacgaaatgagtccagaattctatcccctgtactaaatgcagacttagatgatacagtatatacaagaatgaccaatatatctctagtcatataggaaaaaatataatatttggatgttttcaatttccaccaattcaaaatgtcaaactcagggtggtcatcttcaacatcatcctccaaatacctatctattttggacatccttccccttcactagatatgagatttaacacatatgaagcttcaacatactcatagagataaaatgcatgttgcagcaacatctaacatcaaataagttgagttccactagttggtacatcaagtattaacatggccttagtggatatacttacttcttcagcacacctcttaaaacttgcaaatctacttagagaagacttcacaaacttacatgcaactcttatttttctaatggataggtcaatttctttcaatccatcactaataattaaattcaaatgagcagaacatcgcatgtacatgaactcaagtattttattagaagtgaaaagttgggcttaatattatttattttaaaataaccaaaatataagtatactatttatctattaaaaatttgttgtgctacattactagtgcctaaaattattcataattttgtccgaatttagtaacaaataaaatgttgtttctattaatttttttggcaaaagaaacaaattaattgggtcatatgctaaactatgggaaaaaaataatttttaattttaatatatatatatatatataaaaaatttatattattatttacaggttcacggattgggttaacgagtcaacggatctataaatctaaatccgtaacacaatccctacattatcgattttgatcggttcggttcgattttgacccaaatacataaatgacccaacccaaatagtttagatcagttcgggttcacgatgacccgtacatgtaaacatcgcatatcctgttttttaaaatatatattaaacataaataaaaaatattttttttttccattcattctaattatatatagcgctacctcgtagttttatgcatcggtataacagaaaacagcaatatatatatatatatatatatgtgtgtgtgtgtatgtgtgtgtgttttttgaaatttaacttaaatgttacagcccagccattcattattggtcatgactggcttcctgtaacaagcaaatataattaatgttaaataccagtacgacttctagaaatgataaatgacgaaacgataataattcattttaattagtattataaaaacaaaaattcgaaatagcgcgtacccaatgaatccacaagaaatttagagctcgaagtagcagtttaataatttaggtcaaaagaagaagcatggtagtagttagtagagtccaaaatggaatgctgcatttgcagtactaccaagttaagctagctggcatagcagtgtacgtagtggcagtcaacttcatgcactctctctcgataacaaacacactttatttagattactgcacgtacgtatgaatacgaaaaatatcaatctccaattcaataatgcagccaaggtcacaacattaagtagattagtgctgcccataatttttttttaaatcgaaccaaatcactctattaaaatggtttattttgaacaaaattgttttcatcataaagtggctagtttaactttaacttggttcggtgtttagtttagttttttcttttcctcatacgtatcaagtttttttaaagaactaaactgaattactttataaaaatagttttggttcaaacttatagatcatttttataaagtgattcatattcaattcttctcaaaattataatttggaatggtcgagttagaattgatattcttttcactcacagggtacgtacgtgagacttcattgagcattaaacattcagtagcctctttcttttgtattttattccttaaattaaaacgcgttctattctatttattttctgcctctttcttttgtatgtccccacacgctatctccctttcctccttaattccaaatttccaatgcaagacgacacaaaaatgttactttctccttcccttggtccgaactccgaatcattatccttctggtagctgttgagagttatatgcaagtcattattactttatcaagaatcacaagtaggacattggaaaagaaacagtgcggattctgaatatttttgtagatgttgctgatagagagagtcctcgcgcggtgttgacaacccttcgaacgttgagacataggaatgtctctacttaacatcaaatgcaagcaaacgaaggtggtcttcaactccttttcatacctataaattaaaggtaacatttcaagcttcaaaccctggtcaaccactattagctagctataaatccatgatactactactagtattgcaatagctagtaaaaaaaaacaccatattaaattttacctttcaggtagacatttatacgtatgtgtgggaggggagttaggggtcaggctacaagtcatcggcaaatttaaaataattcaaatcaattcaaacaatttaaattagatattttttgtgtttaggtcaaatccaatctaacttattcaagttcattgaattttggattgaattataagtgtaatatctagatccgcttatttgttgatccaacctattgacccgttaatttatattaagttgttattatatatatatatatatatataatatttttaaattttaaataatcaattactattattataaaacttatagtaattaagagtgagattatttttctcagttctcatgatttcactcagacactctcacaaaattaggatttcaactcctagctgctgatagaacatctattttgcttttttttttatttgttttaaactattttagatttagttgaaatttcaattatactactcatggtttgataatttgataacattgaaattttcaaactatactgtaataattttagttattgaatttttaggctttgtgagtgtgtttcttaaacttgtttattatatttcaatttatatatcatatttaatataatatattagcatatgtgatgatgagacaatgtgattcctctctttatcttttcttccattatttaactacaagtaataattataagtaaaatattcggtatttcatttaataaagattttagcttataaaaatattagattttaaaaaataatagacaaatttaaatgatttgacctgttgacccaagtcaaaccatttataaatggattagtttggattgagttttattttttttcttaaaaaattgacttaaatcaatccgttcaaatttaattaaattgaataacaaatttcgtcaaactcaacccaaatcaacccgtgtacaccctaaggggagggttggttaagtttaatttaaatatttcttttaatttataattttaaccatttatatcactttcactcataaaaaaaaaacatttaatccacatgcgtatcccatcccatttattttaacgatgtcctttgttaagcataatttactatctgtatttaaacattctttgatgtttggaaacttaaaaagttaaaataaaactataaacaattaacaaagattggtctaattgataagaaataagttcatatcacaaaaagacgtgtggatttgattttcattcttcatataaaaatcttgttgatgaataatttgtaagtaactctataaatgttcttaggacttatttaacattaatgagaaatccaacttacctaaacttttcaatagaaaaaaaaaacacttcagataataaaactatatttatctttataaatacttttgcactttttttacaggaaaaaaatacttttgcacttgtcgattaattatttaaaaacttaagtattaataccttatgatgtttattgtaaagtaataatctcctcaggagtctcaatccagcaatgataaagctaggttgggaaaatgccaatacttggcagttatggttccattaggtcaaattaactgctcaatattttcttaattgtaattaattttcatttgtttttatagattctcaaattaagagtattgctacttcataaaatagaaaataaaaaatcgatataattttttttactggaaaaatcgatttaattaaaattataaaatattggtttaacttaaattaaatttaatatttttcaaccgaattaaacttaaataaagtttttgatgattaatttaaataattttttacctcgcagttgcttaagacttgaacttcccctcccaccgagccgaaagatgtttggagcatggactttgaccacatcgaaatggctgaattacggttgcaatggcgtgcgaattaaagaaattcttgcacagaattatctttcattacctccaaataaagaaactatgtgattgccaaaataaaaaatatataaagaaattcttcttcttttaatcaatttttataatatagagataaataatacattttagaacaaaaagattttgggattatgatttttttaatatgattatcatacagtatcttagaatttgaatgtattggacaaagaatgtgaaatgtctcctttttttttatatttcttcaagtgttctaatttatagttccttgggagcagaaattgttaatcatgcatgtcttggtcatatacgcttgcattaaatgtttggaaacgtttagacacatccttttatattagcaagttttttttttttttttttaataacaaacaacttttttccctttattcttgcattcatagcattgcaatgttccctaaaaaaaaggataaatactatatgtttttcatcctttcaaagtagtagaagttcaattttcatttttttaaaatatattgtcttattttagttcctaaaaatttaaaacgtattaatttttgttcaaacatctaatattagtggattgttgttgtgactaataaagttccatattaatattgtattagaacatttttaataagaatttatagaagaattttttaagtaaaaaatttgtttcttattatagtttcttttcattggaacaattttactcaataagaagagtttatataaaataagattttgtatcttatgcaagaaattatttcttaataataaaaataatatttatctacacataacaatactataattaaattataattaagtggaaaaaatataaaaatgtgaattttttgaaaatttttaaaatttcttaccattaaaataaatttgtgtatgaatttcttacgatgacatgacattataataaaaacaaaaaaaatactataaaaatcataaaaaataacttaaaaaactcacttaaatttttttcatcaaaaatgtcgtcagtgaacattttgaatgaatatctgtcatgtgtcattcacttcggtacatgattatcacatatgacaagataattttttttctcccttaaaaaattaaatttgattttaattactataaaatttataagtttgggtttttgtcctcataaaatattatatttttattttataagtttgatttttagtcctcataaaatattgtatttttattttaatataatatattatattaagaaaaaaacaacataatattcataactttgttaggaatgaccatggatgggttgcgacagatatatttttgattctacgcatctcaaaactttgttaaggatatttatgtaagtttaaacccctcgattaaaacccaataatagatgggacaagatggacgaggtcaacttgatttattaatgtaatatattactttttcaattcttagttataaaatcattttaattaatttatattttttaagaaaatgattaatttaattaattacattaaatctggtaattcattacagtatcattataaaattataattttcttatctctaattatttaattattttcattaatattttaagagagaaaaattaaggatatgtaaaaaaatttaatgaatctaaaaattagaaaatagttttataaaaaaagacaaataaatttctgaaaagtatcttataattagaaatgaaggaagtaatattaacattattaactattagaagaaaatggatacttcgtatttaactatttttctatgttttttaaaataaaaataaagataataaaaattaatggatgatgtgtgaaaatagttataggaataaaataataatttatgaatgttagtgataaagatataatacaattatatagattaacgaaagatttgtgtagaaaaaaagttgttattaatttgttggctcaactgctcaagagctagttttgggtcaaaattgcttccagtgccgctgtcaccgtaactcttcttttaggataaaaaaaaaaaattattgagttatgaatattatgttattttttaatattacttaatatattatattaaaaataaaaatataatattttacatttttatgagcattaaaatcaacttttttaatttttatgaggacctaaaattaagcttttgaattttatgaagaccaaaattaaacgttatattttgtagaaactaaaatcaatttttaaatttaggctaaatatgattttttttctcataaaattaaaaaatattcgaatgtcgttcctctaaaatttatagtaagttttttttttctttacaaaattaaaatatgttaaatttggactagagctaggttgagatatattcaattaaaatattaaataaaaaatcaacagcatacgtctttatgtatttagccataaggataacaaagatacgtgaatcatgaatagatgcaaacctatgtagtgcgtttaacacttccaaattaaattaacagatccaattattctaatgttgaattctgatggtcaattctacatagatcaaataccgtgcttttctttcaattgaagataaacgttggatgcaatgcaatgcaatacgacgctcgagggagttgtgaaaattgaaaaaagaaaacaaaatgttatctagtctcatcatttcgagctatgttgctcatttcttaattattacacatttgaaaattacaaccaaaggagtctaattggttatacaaaatatatgaattgttataaattctcagtatctttgattcttatgaattttttttataatttttgtgaatgatttaccctgttttaattcttatccacacaaatgtaaatcacaaaaataaatttttagttacttttaaattgtaaaaaagtagaagttatactactataacaggagacttgatttaattttaaatattctcaatctaaatttttggagtttttctttcttcttttttaaccctgggaaggcaagcgatatcaagatatggccacaacgcaaccaatccgaattctataattaatgtttgaatacacatttcccacatccaactttgagctttttccttagcgtctcaaacgcacgtttcccacgcgataggattgcaaaccccgttcttccttgtaactttttttggtttatgcttaaagtaataaaattgggtaagatggtttgtgcttaaagctagtaataaaattgatttgggtggtctacccttaaagtaataaaattggttggggggtaaattacattttaaaactattagcagaaactcaccagaaaattattactatataagtctaaaccacaaacaatttaattgattcattcaagactattcaactacttctacattaagagatctgttttaggaaggttgttaatcaagatataagaggcattaacccctcatcagaaggatcagaattaactctggatcctttaccaagttgtcttccatcaagttgcaactgagcattttacagatattttcacaacaacaaaaaaaaataatgcaatgcacaatataaatactcatattgggtttggcatagttttttgttttttttgtcacatgctcccaaccagagtacaaaagctactaacatcaccacttatgcaacccagtgtctatcctcatctgatagcatataatagtctctgactcactccctatcattttcttccagcttgaacaaccaaagagtgaaaacactttcatggagaccaacttagattattccaagatgctctttttactcctccttggttccacttcattgattttcctctcacacttggcttctgcagccactcccaagctcaacactcaagagtgtaaaactcattccttcactcattgctgttcacacactttttatacttgtatcaaatcagttcatacttcataacattagtttataatcctttctgctttcccatgttttggatcggaacatagagttgcaaaagtgaggcagagtcaaaagtggttttgtctctctcatttcttttgtttggatctatggacagcaaaagaaaatcatggattggttgtttcatttcatcatagcttctaattctataattctatgcatatgcatctgtggtaccttaagactcatttgaatgttgtttgctttttctctgatcgatgaagttgatttggttgaattgtgtgcagtgaaggcattgaaggaaataggaagcaagattgggaagaaagactgggactttggggtggatccttgcagtggaaaagggaattggaatgtgtctaatgctaggaaaggctttgagagttctgtgatatgtgattgttccttcaatcacaattcttcttgccatgttgtaagcatgtaatgctctttctctctctctcttttaatttgtttcaatcaagtttttggtattctttgtgttttcgagaactcagattatggacgataatcacatggaatcacatgtgcacttaggaaaatgaagatgattttcttcaagttttgattaattaattaatcttcacggccatattgcttcaactatttttaatttattactacagacagcacctaaagttaccatcaaaccttcacgtgcaattacatatttttttaagataaaaaaattgttcagttataaattcatgttttcatagctggattccaagaacctttttaattgaagcaaaaaggaagaaaagggtaatgggtgtttttctactaattttctttttacctagaatatttccaaagatttatgcatatcctgcattcttcaaaaaattgaccatcgcgaatcttaatcatgcacatttgtggttgtgactcgtcaaagtaacgcgtagcactaaatgagaagaggaaaatgtttcttttttttttttttggtgaagagaggaaaatgtttcttggactatatttttaaaataaatgtataccagaaaaataaaaaataaaaataagtgacaattttttttttttttgagagagacaaaattaattatatacttatcatgtataatgttgatttcattatgtttaagtaccagaactcattaacatacaaaaaatttaagtttgaaatgtcggacacgggtctcaatcgacaactcaaccgacctgatgcaagttgcaaatctttgactttgaaaaggatgtgctgtctttatctttttttctcgtcaaaattttcttaaattttttaattttcatctgttgggctatacgttcatgtttttgcttcaaactatttttttttttttttgttacgtcgaactttgtctagtaaaaagtaatttgttgatttttttaaataggaaatgttgattaatttatgttcaaagaatgggaaagggtttactgaacactagatcaactgttgagtgttgatggttaccacagaaggggtactaatcactagtctcagagacaggtcaatgaccaaaaatatgtagtattatttttcatagataacacaattagtttttagataattattacgaaagtcagcaattttgacattcataacaattcatgattgtttgatactgtaagatactttaatattgtcaatcaaggtcgaagatcgtggatagtacaaggaaattaaaatattaccttaggtcttttaattttattttacttattattatgtaagtttttatataaatctgtttttattgttcaaattacaatgaacaatgatgttttataaaaagttagttagctacttgtcttaagtaacaattagaggtgaaaaaactaaaaatcaaaattatatatataattaaaaattgaatttgtagtttattataagcaattataccattaattaggaacatggttattaatgttagagatagaaaaatttaatagcattaagggctaaagatattaatgcatgatttatcaatttctttaattaaaaataacatttattcaacattctcattgtttctttatctctttttcatattttttaataccttaattgatatcagattttttttttataaaaaaattgtttatattatttagtactttttattcttatattttgtagtaatagaaaaaaatcaaatagaaagtaggaacttggttttcaaaagttaaaataaaaataagttaaaaaaaatctcaatatataatactcttataaatgtcttactattcataaaaagaatatataaatatgagtttaattggtaaaaaaaagtcacaaaaaactaaaaaaattattttaagaaataatttatataatattaagtttctttaaaaatttgactaatgccctaaaactcctaaacacggtcctgctgtcaatacattctaattaaattcttgaattaattctaaattctactttggttaattttttagatttaatctttttgtgaggacttcctaacttttgtacacaagggactcacaagattgtttcttttctcatttcatgtactgtatttgtttattgattggatatcttggaataatcatgttaaccaccatataattataaattctgaatttctgctttttatttcatattctaaatgaacagattcttgaaggctcagaatctgtctggtattctctcaccagagttttccaagcttcatcatctccaagaattgtaagatatcaaatctcagttttgaaaccatgacttttttttgctctgcatgatgttccctatggaatggtgaagtccactaactttgtcttgcactttcaaacagagaccttagtcgtaacatcatcactggttctatacctccacaatggggtaccatgcgcttggttgatctgtaagaactttctgctttgcaccctttggtttctctgcattgtctcttcaatttcttctgtatacagtaaacaacttgagagtgacactaaagattcttgtgaattgaatgtgcagctcttttatgggaaacaaattgtcagggccattccccaaagttctcaccaatatcacaaccctcagaaacttgtatgttgaaatcatttctttattttcaaatgaattgtatgtttactccatcacttagcttagtgataaattggatgtatttttaaagaaaaatagaaagtaaaaaaaagaagtgaaagatatatttggaatatctaaaggtagcttttaccttttgccaatatatttgcttttacctaaaggaagcttggcataggtgatccaggattgttggtttagtataatttccaatttatttctgcagctttgtttaaattaaatatttgtatgaatgttacaggagtattgaaggaaatcaattttcagggcacattccaacagagattgggaagttgaccaatttagaaaaactgtaattcttttgatcttctttgtgtgcttattggaaatttggaatctcaatatctgcttctattttccccctcacatattattctgtagtgttttaacatgagtaaatcatgtttgtttagcattctgtcatccaatggattcacaggagcattgccacccgtgctttccaagttaaccaagttgattgatttgtaagttcttatcaatttaacatattctagcacatggttacaatctgacagttaaagatacacaaagatgagccactttgattctatttaatattaggtagtgaggtgttaatgcaagtcactgcaggtttcttaatcaattcatataaggagctacaaaattaaagaatctgtagctttgtttatcacttttgttcttttattgttgttacatttaaattttgacatttccttgcatactgattaacctttgggaaacacattttaggaggataagtgacaataatttccttgggaagattcctgatttcattagtaactggacattgattgaaaagctgtaagtttcctacctcgttcattcttgttgtatttgttgtatagactactttatcatgttaacttttttcttttggggttacaggcatatgcacggttgctctcttgaaggtcccataccttctagcatttctgccttgacaagattaagtgatttgtatgtttgtaattctttattttatttatgttttggtcatagaagatgaatatgttaagtgattgttttatttattctttgatacttaggaggataactgacctaaaagctagtaaaagctcagctttcccaccactaaataacttgaaatccatgaagacactgtaagttcaatgacttaaatgcttctttctcttgaagtctttataaaattgacctatattttatttggacatcataatgcagggtattgagaaaatgcatgattaaaggagaaatcccagaatatattgggagaatggaaaaactgaaaattttgtaagttgttcaacaagtaacttacaacagttttgacaacatgatatattactttgaggatcattttccacttgagaagatctcatagaatcaattcaaagttggctaagccttcttttcatataaattataatattgacactacgctcataataatgttctataattttatctagatctgaaatataatttttttccaggtacaaggttttgtaggtcagttatggtattattttgtttatagccgtgaaacatgggtaattactaactagcactaaacttcattaagagagaagcaaaaatgaaacagatatgtctatagtctttccggtgtagattgatttttcaaagttgaatggttgttgctctgatgattcatgtgtcccttatgaacttctatcatagaccttgctttacatgaacaccatatcactttgtttgaataatactgaaggaagattataaagacagctataaaatgtagaacatgctcatcttaaagttgaagataaaatacattttttataatataaaattattaaccctttcgttacataaaacaagttcatttatttatcttcgttgctgtagagatttgagttacaatggcttgagtggagagatacctgaatcttttgcccaacttgacaaagtagacttcatgtaagtggatgcgttgaataaaatatgttattgatacatttcatttttaattttgacgaaacaaaatgtattaaataatgcaggtatcttaccgggaacaaattatcagggaaaatacctcgatgggtcctcgcaaataacaaaaatatgtacgttaaatacttgaattgttatgtttcaattttcagtcttcatcttaatatttgcttcagtggctacagcgaataaggcagtgaaatatatgacaaaaaatataatataatataataacaatagagtttaaaaaataattttcaataatattaaattttacaattttaaaagttgtatataatgaatatttaaaaaaaaaaaaaaaaaaaagaccgggtcatgtgagttaattcatgactcacttatttaatcattgatccaatatcttgactggatcgatcaccggtttggtctttaaaattatgctctctgggatcttcaagccgttgatgtctgcatctgaaattaaataagcactcctttagcaacatgagattaacatcttttattatatattttggtgcacagtgatatctctgacaataaattctcctgggacagctcaagtccaactgaatgtcaacgcgggagcatgtaaagttttagtttatttaagctttgagtaaaagttgtcttcaattagttatcagttatcactgcaacattttttttttttttttccagaaaccttgttgagagctactcttcatctgtaaatacacagtaagctgttgtctttggaatattttctgtaaaatttggttattggtagtagccctagaatataaccttaaatttctctcttggttgcagaaataagattcattcatgcttaaaaaggaactttccatgccctgcttcagttagccaatgtaagtatgtgaccatactacaacttttaaattacttttatgatctgatgggctggtttaaatattgactcaaattctgtgacctgaaattgagtgaaataagttgatgagaaactttcaactcaacatgatttcataccaaaagaaaaatttaagatagtcatataacatgattttgcttatgattctatttacgcaaaagttcactgcctacttctttgctaacaatcttaagcccagagttgtacagaaattcaaataaaacaaaataatgtaagaaggaataaatgtccattaggagagaaacaagaatataactgtttttcttaaggggttaagactaatttcctccttttctaattatttgaaataaataggttgactaattctaagaaacttaaactggaagataatttgatatccttttttattaccaccattgaatgattgtaatgacattttattcttttttattacaaccattgaatatgttacattctttgcgaattttacctttctatgcagttgtctatttttaccattagaccattacaatttgaaagattttacactgagtattctttcttttcaaccctgtttgtcattgttttttcaatagatcagtactccctgaacattaattgtggtggaaacgaagcaaatattagtggtaatatttatgaagctgacagagaacaaaagggtgctgcaatgttatattacactagccaggattgggctcttagtagcactggaaacttcatggacaatgatattgactctgatccatatattgtggccaatacttctagacttaatgtctctgcactcaattcacaactatacacaacagcacgtgtttctccccttgctctcacatactatggcctctgcctaataaatggaaattacacagttaagcttcactttgcagagattattttcatcaatgataggtcccttaacagtcttggaaggcgagtatttgatgtctatatccaggtaacaattacttgcttgatttgcaaatgatgctaaataattgatttgcaaatgatgctaaataattgatttggactgagttgtgcattgatgtatatggaatatattattatgtcctaaaattaaggggaatttagtgctgaaagactttgatatccgaagagaagctggtggtactggcaagtcaattgagaagacatttaatgcttctgtcacccaacatactttgaagattcacttctactgggctggaaaaggaaccactggcatacccacaagaggagtttatggacctctagtatctgctatttcagtaaaccctagtaagtcacatatcatgcatcttagagttagtgctttatatgacttgataagactgcagttgaaaccataatccattatgaatttaaaaattgtaggaaaagggaaagattaccactaatgtctacctctacaagacctccactagagttctgttatcaataaaattcatcattctttccttttatctgatccagttctatcagttttgttcttcatttatgcaaaagctaaaagtaaatatttttcccttgcacagattttaaacctccatcaggggatggcaaaagaacttatgtcatactggccattggcatagtagctggtgttttagtggttgttcttctggtgctggttctcatgaggaggatgggatggttaggaggcaaagatccagtgtataaaggtatggaatatgccaccaagttcttccaattcttttagttagaacaaatatttccatttgtttccaacacaacatcttttctgtatccagcagtatttgcctgagcttattccagaatttgtttaaataaatatttctacaaactttattcaaatgtcataaaactgaagtgcaacaatttacttctatataagatttgtaattgatgatatttctccatttcaccaaagtcaaggctttaagagaacatacgagagtatacttgcctgccctatgtattaatatgctagatagaaatgaaatgaactatgtgacagatattgtagagaaagttataaactttcttgttgaatccaaattaccaatattttgttttttattttcagagctcaggggcatagatctgcagacgggattatttacactaagacaaatcaaagcagcaaccaaaaactttgatgcagtgaataaaattggcgaaggtggctttggttgtgtatacaaggtacttttatcttccattcttggttacctattccatcttatggttaatttatttgttacttgatttgaaatagaagacacacttcatggtctctatatctccattcaattctaatttaacgcttacaatttaatcataatttctgtaatgtattttgtactcattagcaagcatgtataaccttcgtgggttaatgaaagagaaaaattatccacgtacatgatggttaaagtgtaatggagatttgttagatcaatcagcacttcagtagtttgaatatgtgtacctgtgtaatgctaatgcaagaaaaaaaatacaccttgttcatgatgcagggcctactatcagatggtacaataatagcagtaaagcagctttcttcaaaatctaaacaaggaaatcgtgagtttgtgaatgagatgggactgatatctggacttcagcatcccaatcttgttaagctttatggatgttgtgtggagggcaaccagctaatactgatatatgagtacatggaaaacaattgtctatctcgcattctttttggtaagcttcttgatgaataaactttagccatacttgccatttgaatcaaacatttgatataactaactaactgattgtccttctcccaatcacatacagggagggatccaaacaaaacaaaactagattggccaacaaggaagaaaatttgtcttggtatagctaaagctttggcttatcttcatgaagagtccagaataaaaatcatacatagggatattaaggcaagtaatgtattgctcgacaaggattttaatgctaaagtctcagattttggtttggcaaaacttattgaagatgacaaaacccacattagcactcgagttgcaggaacaatgtaagttcatattttgctactatttctcttgttttcatatcaaaccatggtaaaaatacccatttttaatcaatagtggagattctggtaaaaatcaaatgcatgtgtatcatactatgaagttagttataatttcaagcattaaatatttaacccatggttattgatgtactttattctgtaaagtatactcttagtcaaatccattattttaacaatgctaaatgcttttttttttcattttgcagtggttacatggctcctgagtatgcaatgcgtggctatttaactgacaaagcagatatttatagctttggtgtggttgcactggaaactgtcagtggaaagagcaatacaaatttcaggccaaacgaggattttgtttatcttcttgattgggtaattagaatttatcttaatgcataatataacaggctcaaacaaacaatagatactaaattaccaagacctatggattattgattttactagttcgtacatacacacatgcatatacgggcatatcaagtgagagggattttttgaaaagattaaatcacaaagttgtcatttttcagtgatcatgtaatcattaaatcacttttttttaacatcaaatgctagtttttagttttttatcggcaaatgttaaatcacttttaatcttaacgtatagttatttgtctagaattgctcatatatatatatatatatatatatatattgtaattctttttttagagttttagtatcaatttggtctaaaatttggtctaaaatttgagtttcattaggcatatgttttgcaagagagagggagtcttctggagctgattgatccaaatttgggttcagaatattcaactgaggaggccatggtggtgctaaatgtggctctcttatgtactaatgcatctcctacacttagaccaacaatgtcccaagttgtgagcatgcttgaaggttggactgatattcaagatctactttcggatccgggatattcagctattagttcaagttccaaacataagagtataagaagtcacttctggcagaatccaagcggaacacagagcatatcaatacctagtatttatactgattcctctggctcacatgttgaaacagaaaagagctatcatcctgtaaccgttaattcagatggatcagacaactgaaattcgtttcttaatgccacatatttaatacaaaactcgtggtgtattcaatgcaagaaaagagaaaaacaaaattaaaattaataacaatgtaaagagttttatcttgtcgctagttcgcacaaaatttggggtgtcataattagggatgacaataggtaggtctaggtaaggtactatagtatatgtttctatacttgcatttaaaaataatacccgtacctggtcccataccctttcaggtaataattttaatcttattttcgtacacgtttgatacctatatgcccatacccgcacctgtgactcgcacattacttatgtataaggttaataataataaattgataaaaataatttaattaaaacaagcaaacataacattaattcgtccaaactcaagtcataaataaaaaaaataaaaaataacatacaacatagtgattgctaaagctaatattttaatcgctaaacaaaaactctaattaaaggtttagtatttttcactctctaacagtgatatggttagagattaaagacttagagttttatcataaaaatataattatttttcacaaaatattatatatatatatatatatatacaatatccgtgtaaatttgtgcatatacttgtccggtacttagtcctattattatgggtaattatttatcccgcttgcaaatatttttgcgatattcataaaacccatatatactttgtaattcctaatcatagtttggagctatggttatggaactattcccatcacaatggggtgccttaatttagggttattcagtaatcttatttttgccttaaaaaaaagattagttataatttacgttgacatgtgaggattgctaacaaagtctctattgcttaaatttatctaaagctgcaaaatcatgtgtaaaagtcattaaataaagtgagacgtacaaaattttatgattttaaataaatattaattaatgataaaaaaagtgttcaataaagtatgttaacgaatatattactaacatttcttttgatatattgttaaaatgtttttaataaaatatttaaaaaaaaatagattattagccgcgtagtccaaatgaaatattgagaggaaaaaaaaggctaattgaatttcagcatattttctttattagtgcacccaactataggggggagggggaagaaataatttgtactggtacacagaaaactctcttatttctttaacacaaacattttgctaatcaattgtacattttactgctcccatgagatatgtaaactatgcttatctatttattattcccttgtaacaattaacaaataatttgaaagtagaagtactgaaacgtgacttgcacataaaggcttaacaaatcacaccagcatcgttcttctggtaggtgatggatgtgacaccagtagcattatttatgccgacatgtcatcctgatcatagcaaagttaactttggattataaaaagccatcaacaaagaattatttacgttcgtgagaattatatatcaccttttggtcatcttcttcatataactaaattgagcctgtaagctataccccggatccggcaagccgccgctttgaggcatttgatatggccacctcaccaagcttgtcagcatcacttgatgtagtcctgacattgactggtgtataatgccgtaaccattccccaacgtaaacctgaagcataaaatagatatgatgaaactaggcaagagattgaaataagaaaggcgtcacatgttgttaggatccaattgcaaggtattgggtcttaagtcctacattggaaatatggggttctagttctagtgtaggatttataaggtcttttactctccaatttcaatgactaacttttgtggtgtgattctctcaaacttcttatcgattggtatcagagggtttcaccatgttctcaactgcaaacgagcactggagatcgtgatgccaacattgcagtgttcacctagaactaatcaaattatcaaagtgctgcaaagtgtgatgagatgtttggattcaattgcaagataagggacttgaatcccacattggaagtatgggattctggtatagttataaggccctgtctccaactacaactgctaatttttatcatgtggttctcccaagtttcttatcatgttgtatatctttaggtagaattgaagagtgtggtagttataggtggctctaaaagtttaccatacagttctaatgcattacgcaaatattgcctagtaccactgttaagaaatataatgcagccatgatacaacttgaaaaccattttccagtaaaacaagtgatacacaacaagtacagctacattagcacaatacagtaagcatgatatatttttaatatgcaagaaaatcataacaagaaaaatgatttaaagaaagaaattaacctgttgaggtctcaaaatctttgtatcaggatcatccaaggactctctccaatgagccaagtacccagccattcgagggatagcaaataaaacagtgaaatactcaggtggaaatcccatggccctgattgcataaaactattagttcaagccttgtatggtattcttttttttttgggggggggggggggggggggggggagagggggcatatttttatcctccaagttagaataactgggtgaaataatggattacctataaattaatccagagtagaagtcaacatttggatatagcttcctcttgatgaaatattcatcagatagtgcaaccttctccaaggcaactgccacctgaacgatcaaataattacatacagaagttagaacttttgaagtccatatactgaccaatctacataaattacataggtactttcctggtcagggaaaaatagtgccagaaaccctagtaatactttaaatttgaaaaatgaaaggtgttgctagagatttttaatgtcttaagatcttcatttgacttgatctgctattttttttccaaaccaaacaagacatctaatgattatgcatgtagacacaatggtgccaaacttgtatgcacaaacatatacaatatacacactaagcatactattctgtaatcaaaattaaaaatacaaaaatacatttaaataaaacaataggaaattttttaaatgtagtagtttttctctgtattcacagccctgatcataggcctcgtgaccagcataccaagatcaaggaatatataacagacaatagacacaggaaatacggaatggataaacacctcaataagaggatcccggcccacaatggaaaacacttcctctgccagttttcttaagacctttgccctgggatcatagtttttgtacactcgatgtccaaaaccagagagcttgcgtttcctggaggaaaaatgcaggacaaaaatatcaactaaaactatcattttctctgcttgctgaaaagagcaggtatcatgctatcctttcagggtataagcaatgctaacaactaaggaaagagtaaaaactagataacagaagaaagtaatactgtaatagccacctggctttgacaccttcaatgaactctggaatgttctgaacagttccaatttcactcagcattttgaggacagcctgcagaattgaaggtcacattaacatgttcccatattaaataacagtatagtgtttgtgtttattcactacgttccacctagcaatacataaaagatcatgactgcttcattaaccacttatagctacctcattagctccaccatgaagtggtccatatagagctccaacagccccggcaatagcagtgtatacatcaacgccactgaaataagaataagatatatagtttagcaatatgacggttttatatttgctttatattgcttaagtagtattgcagtaagatgtctaccttgatgcaaggtgtcggacagcagatgtagaacaattcatttcatgttctgcgtgcaggatgaagataatgtccagcgcacgagttagcctaggattgggtttatatgaccgattaccgctgaaagtatgcacagtggagattgtgttaatagttaaaactctaaaaaacagctagtatgtggctaccattctatcacttaagattgaattatacctctttttaaaaacaaaaatggatttgttatatatgagcaaaactcaaactaccattagtctataaagcaaagttaaatataaaaaagcaaggttgtcttaattcaaattaacgatcaagcacaaaaataccatacatacaaagaatctagcatgtataggaagttctctgtgtaagaaaggtggttggatggaagcacaggtggccttcctgccattctaagataaactgcagcagcaattgttgttatctgcagtaaataaaaaggggtgaaaatatgatatggcaataaagcagtaggacacataacaaataatcatagggttgcgaggatagtggacaaaatcccacaagatacaatcagtaaaaccagggctagaatcattcaaataactaaataatttgcatgttttcagagatagaacagtgaaaggagaagaaagaaccaaataagcacacctttccaataactcgtgttatctgtttgtctcttatttgctttgagtcataaatatcaagaccctgcattaattataaaaaaaaaaataatgaaaaaggatcaaatctggataaaggaatataacagagcaataacaataaacaatgttgaatcctaattagagaaagagtatcattcacaagtacattgtagtaacccacaggaaaaagtagcatccaaaaggaatcccaagattagttttattatatctcagtatctcaaatctctaatatgccccctcattcactccagagtcctttggactcgaagcatagacaatgtacaaatttgtattaaaattcaacttattaacaaaaaatgacttgacagcagtttttgttacttactctgagagcgggatttgcatcagggtgaaaaacagaaagagcactcatggcattaacaagcacacccatgggatgtgcatcatggggcatagattgtatgatatcctacaaaataaacgtaagatgataccactacttagttagattaataatcccaaactccattgaaagaaacaaacaacataatctttctattttattttatatgatcacttcaagagctactagatttctttaacaatataaaataccactggcatactaaatttcaagaagtaaaacaattagtggaagttgttcacattttacaaatctaaaagctgtcactgactgaaacaaaaaaagttatcatttagcggatgggatttggagaacataaaaacacaataagagttagtttagataaagcataaaatctcaccaaaactccttgtggaacagccgaatgctgagatatagcaaactcccattctgctaactgactttcagaaggcaaacttccatacacttgaaaacagaaaaaaagatgcacgttaataaatttcagaagaattcatgctacatacatatcgaagcacataattaacaagaagcagaactaagcccaaaattcaagtgtcttcaataacataaaatctgtttaagtgaatcctcagtcaaaatgttttatctactcatacacaagcgccacagaagcctcatacacacatttgcagtgaaacagaacactcacttatgagataggacacttccgtgaaagtgcttttctctgccaactcctcaatagggtagcctctatatctaagaatcccctcatcgccatcaatataactaattgatgatcgaacaggagccgtgttcaaatagccaggatcataaagcttgagtcccttgtcattcttcccagtcgatatctgcaaatccaaaaaaacccataacataacaataactaaactaataagagtaaatagtgtatatattactttcattcaatcacagactacttgtatgttaagtttgttgacttttatgctaagatggtttcttattggttggtagtgtaaatttacactgagcatgcataaaaactaaactcaatgttaagtaagcacaaacagtcatactataatcacaaaccatcccacctaagatttcaccatgcaactaggaataggaaaaaagcccactttgcaaacaattcaacaaagatgaaaggagcagaattggtggagacccagtttgcaatattggaaattccttggaaagcaaagatcgaaattgaaaatttcatggatgaggaggaaatttaccttcttgaggtcagaagctttgacagtgccttcattggagacctgaagctggtacttcttgccggttctgtcgtcgacgacggtcaaagttccgtggaggttcgtcggcggcaactgagtggagagagggagagggcggagggcgtcgtgatcagtgagttcagaggggaggaggtgagcagcgagcatggccaaacggccacgagcatgcagcgtcgctgctgctgcatctgaattgcttgacatgttctctcttcagaacacaacaactattggaattcagagagaaaaacggaggatttggagttggaggaattctgaagctaaaagagacgtatacgctcttaactaataataacggataatcttgtctacgagtttagacttccgagaaaaatattaaaaaatttaagaaacttgttattgcaattttttacagtatgtaacaagcgcggagtagttatcatttattaatcttcgtagaggacctaattaaccatgaactattaatggtatggtatatgctcaatttagtccctaaaatatatatttgttgacaattttacttttatattatgaaaatcatttatttagttcacaaatgtaaaatgttacaataatttggtctaatcgttaaaattatttcatattcattattggagatagtctacatgactcactcattcacataatgacttttcacattatttttgactaaattatcacatttttttttaaatattgatttttgaaacaaaagtaaaatttcattctaaaattttttcaccaaaacatatatacttactaacaacaaattaatccctaataaatattatgaactgataaactagtccgcaaaataagttataacatacacttagtaatataatcatccataaactaagataacatacacgtaatctacgaagctaaatcgagcatttatagaatataaaattattattcattaaacataaaatatcgaagttcccaagtagtagtaaaacttctaccaaagcatgccacaatgtcaatgtcataatagaaatttccaaaaatatatccaaaatacatctaaaacacgttaatgcctaacttttcaaaatatatccaaaatatgtttaaaacacgttgaatccttttgaagggagttgaggtagttagatatgtggtataggatgaagctcatcaagcttgattgtggcactcttggagatacttcaacttggaaatgaaactctaagcatatgagtatttgcagatcggataggaagtggtctaagtgcatgtgtaagtggtacaaatgttgtgacattaggagctgttggtggtgtaacttcaattgcaaattttgagaacaaaccatttcttcatgcattgaatgaatgaaattaaaataagttattatattgatgattgagagtaaatggtttctaaataaataaaaaaatagataacaaaaaatatgagtatactgttatttgagttgttccagcgtaataacagcaactacaagtaagtgtttccattttttaggttgcagcatctcatacaagtaagagtgggaaaattctttgtaattgacatgatatttaaaagttaatttacagtttatttaattaacttgtaacattgtttaacaagagtaaaagtataggataaactaaatttataaagaatagttagtcttatatttatttgttagcgttaaaattatgggttgaattgtcttagatctaatgatctgaaaaatatatgttcatcttaaaaaaatataaaacctcatttatcagtttttaattaagcttataaagtatgaatggcgcagctaggtaagttgcgcgtggcatgaattgaagagtgcgggaagagaaagtgaaaggaagatgagggtggcggaggaggagaaagcagtgttggagcaagtgttcgggtcgtcatcatcagaagaatctgattctgatggctacagcgagagcgagtgggaggccatcacagaagtgaatggcctatggctgtgccgtcacttcctctctccacgccgccagtctcacatactctcctccatccaagccgccaattggttcccctccccttccatcaaccaggccatgcgcttcggcctacaacacctcccttcttgggccacccctctggcccactccatacgccgctccgtccaagcccaagcccagtcccagtcccaggcccccttccccctccacctcctccacagagaacctctcttcgaccagatgatcgccaacgtctaccagcccggcgaaggaatctgcgcccacgtcgacctcctccgcttcgacgacggcatcgccatcctctctttagaatcttcctgcgtcatgcacttcactcccctctctggttccctttccgttcccgttttgctcccccctggttccttgattctcatgtccggagaagcacgctaccgttggaaacacgaaattaatcgcgcaccggtgtttcagatatggcacggtcaaccattgactcaatccaaacgcacctctatcaccctcaggaaactttgcccctcctctccctgattccacactcaaccctttctttctgttataataatttcaatgttctattagtcagcattcactaaacaaatttcattaataattgtagtaataacagtaacacgtatcttatctatctatctctgttattcggcgttgtttgatttggtaccgaacgcgatgaaattcagctgatatcgtctgataaaaccatcgtgttatgcataactcatattttatgggcgaatttgtgtgcaatgcaaccaaatgaaagtgtcatgtgaatgtgacgattaataccgagcaaatcaaattatttatgatttattacgtacattgatactggcgcgttgtaggatgaggacgagttcttctggagtgagaaaaccgaaccattgatgtgtgcctctcggaagctgccaagttcaaattatttatgtcatatatactggccatcggcatagtagctggtgttttagtggttgttcttctggtgatggttctcatgagcaggatgggatggttaggaggcaaagatccagtgtataatggtatggaatatgccaccaagttcttccaattcttttagttagaacaaatatttccatttgtttccaacacatcatcttttctgtatccagcagtatttgcctgagcttcttccacaatttgtttaaataaatatttctacaaactttgttcaaatgtcataaaactgaagtgcaacaagttacttctatataagatttgtaattgatgatatttctccatttcatcaaagtcaaggcttattaagagaacatacgagagtatacttgcctgccctatatatttatatgctagatagaaatgaaatgaaccatgtggcagatattgtagagaaagttattaactttcttgttgaatccaaatttccaatattttgtttttttattttcagagctcggcaaagatctgcagacggggttatttacactaagacaaatcaaagcagcaaccaaaaaatttgatgcagtgaataaagttggcgaaggtggctttggttgtgtatacaaggtattttgatcttccattcttggttacctattccatcttatggttaatttgtttgttactggatttgaaatagaagacacacttcatggtctctatatctccattcaattctaatttaacgcttacaatttaatcataatttctgtaatgtattttgtactcattagcaagcatatataaccttcgtgggttaatgaaagagaaaaattatccacgtacatgatggttaaagtgtaatggtggagatttgttagaccaatcagcacttcagtagtttgaatatgtgtaactgtgtaattctaatgcaagaaaaaaaaatacaccttgttcaagatgcagggcctactatcagatggtacaatgatagcagtaaagcagctttcttcaaaatctaaacaaggaaatcgtgagtttgtgaatgagatgggactgatatctggacttcaacatcccaatcttgttaagctttgtggatgttgtgtggagggaaaccagctaatactgatatagtgatatatgagtacatggaaaacaattgtctatctcgcattctttttggtaagcttcatgatgagtaaactttagccatacttgccatttgaattaaaaatttgatataaccaactaactgattgtccttctcccaatcaaatacagggaaggacccaaacacaacaaaactagtatggccaacaaggaagaaaatttgtcttggtatagctaaagctttggcttatcttcattaagagtccagaaaaaaaaaatcacacatagggatataaaggcaagtaatgtattcttggaccttcttatcttcattaagagtccagaataaaaaatcacacatagggatataaaggcaagtaatgtattcttggaccttctctgcttccacgacggcgtcaccatcctctcctttgaatctgactgcgtcatgcacttcactcccctctccatttccctgtccgttcccattttgctcacccctggttccttgattcttatgtccggtaccggagtttcagatatggcacggtcaaccattgactcaatcatcaccctcaggaaactttgccccctcctctccctgattccacacttaacctttatttctttctgttataactttaatgtttattattcagcattcaaaacaaatttcaatattcaatactaatgataattatagtaataacagtaacatggatcttatttatttatctatctatgctattcggtgttgttttatttggtaccgaacacaatgaaatttacgttgatatcatctgataaagaccaccgtcctgtcaccgggttatagacgaatccggccatctcctccacctgtgtgtgcaatgcaaccagaataaagtgtcacgtgaatgcgatgattaatccctaacaattgaaattatgaatgcgttttgcgtatgtacattgataccggcacgttggaggatgaggacaagttcctctggagtgagaaaactggaccattgatgtgtgcctctcggaagctgtggagttcaatatatatataatgtgtcgattgaatgtaggatggaaaaaataagtgttgaatggagttgagttgagaagaatgaatacccagtggagaatgtattctgcagcaacaatggcagttgcgtaggctctcatggatcgattgattgtggatatcacagtggctccatctggaactgttagtgctgacagagatttgcagaactctgcaggatctgccacgtgctcaatcacctgcaaaaaaattcaaagcaaatgaaccaatgcaaggcaaaatgtgtccttcaactccactgagtactgtactactatcaaagattttacgctacaagttatgtcatatttttttttttttttttttgtatcccaacacccatttatgcactccaatctgcaagcacacaaccagaaagaggtaaggggcacgaaagagaaagtacctccaaggccataactgcgtcaaacgttcttccttcttcaactagcttctctgatcagtcaaaattgttggtgagttgtaaaatgcagtgcataatacccaaaaacataaggacaattcgaaacgaactagatgaatgcaagcaactttgacttttacaatgattattgaagccatcatgcatgtactgatgtaccaagagcgttcaattttttaagtatatgtaatgtaacaactcttttagcttaaaacttattcacccacttgagcgatttagcatgtccaagtatgataccttgtataatgagaaacattaagggatagagtaaaaactttcttcaatgtaagaccctagtgggaagacataagatcatagcaaaaaaaattgacttttctacagccaaagatacattctaagactctaagttaagataaataacataaaatggttattaactacaagctgtaagaaaaacaagaaatcacaagccaacaggaagtgaaaatatttaagttttttatgccaatgcatcataatctcgtaacttttgaaactctaaactatccagcaaaggtctgaatccatggaaaaaccactcagaaaattagataaaaggaaattatgccagtcagacttgtgcttcttatcaagattgtgaactaaactgtattagcattcatttggataagtagggcatttcagcagtagtgtccaaatgttaacagacttaaagcatgcacgtcaaaaatggatgtaaaacaaaagtgtaaaagaatgcttcaagatttgtaaatgtaccagctgtcgtgcaacagaactcaatagatgaagttgctggatccaaaccctgttgacaggagataataagttgtccggcaaatagtgaagatttaatttactaatgttggcaactgcttcctccaatatacagaatacagcaatctaatcaatttgtaggacaagactgacaaatttcaaatattcaaatataataagcatacagcatgaagttgagcaatcttgatattcttctctacagcatcaacacccatcacagtagctcccaatcgagctagtggctgaagaacaaaaagagaagcatggctataaattataaaataacaacaaaaaagagcacaaatttacaataaaaaaacaataacaaacttaatactctataagtgagagggaggccaatatgcaccaaagaaataattcagatttccacaattcaagtattcaacctaacaaatatagtcacctctgaatccatcataatgctacagattcgcatgaggattatgataacaagtaatatagtcaacaaatatagtcatctctgaacttattataccaaactataggtttatcataggccagattgccagaagataaaaaggaaaaggtcttttccaaaaatcacaggaaaaaagaagaaaagatatacctcagaaagaattccacctccacaacctacatcaacaattttaattccttcaaggggtttggcactataagggtccttcctgagacaagggtgaaatctaattattatttgaatagaaccccgttagagacaaaataaaaatataaacccattgtcaaccgtaataccgtttttcctattgtttttcttcttgtttcttcatttggtttgtgtcaaaaaataattcagttaacactttttattaacagatacttcattagaatcatcttcttacacatccttatacgattatatttaattcaaggggtattaaaccaaattcctaccatgtatgtgtagcaaacactaagtgctattggtttaataagactgcataaataacagtggcttggaatctgacacagtacaaccagattatattttaaacccactaattccatgcaaaaaaagaaaaaggaatcaaattataacatagcacaaagcattgcacattctaccaaagtagtttcaagaataaacaccccagactcaagaatggaggtacaaggactaaatgaaagagcaggcttacttgaaatgtcgacaaagtgcagaacggatgaaagcaagtcttgttggattcatcacatgcaatggcttaaaggggccttcagaatcccacctattcacatcaaggaaagggcaaatacatgtcatccatattctcaaactaacacacacacacacacacacacacacacacacacacagtagcaacaacttcaacaaattcaccccatgaaaaaaaatgtgcaatttaattttaattgtggtgtttataacaataaattcattgaacagattctctctttcgtttcgaaagctgaccaggtatcggcgatggcggcgaacttggcgagctcattgtgcttcaaggatgatgatggaggcgaaggttgttgtttgggctgcggttgaggcattgaagaagcagcatcggcgaagaacctagtagtagcgttaaggagaggctgaaaacgatggtggagaatgcggtggatggagatgcgattgaggtttcgaagatggttgaaagccatggccacggcaatggcaatggttccgcgctcaaaatcttcgtctcttttcctgaactgaacctgaacctgaacccttcagctaggtagatccatggctgcaaacctgtcggagctcctgttttgacccgattgtagaaaacgggttcatgtttttaaatatttagaattttaaaatttggttaaatagtgtattttatgtcccatttttttatatacatctctccatttaaaaattcataaatctagcgatgttaaaaaaaatctaaatataaaacacttctttaactcttccacccaaattatactaaagaaagtcataaaaggtataaaaaaatatgtctattcacatcaccctaaaaaataagattaaagagatgaaaaattgataatttatatagagttattaaatggatccaaccaataactaaagcgcaatatatgaaaagaaagcaaaatacaacactatgaaaaattcaataatttataagaataattcaataattttttaaataaccattttcaattcaattgataaatttagaaaaatatttagtgaaaaaaaaaataaagaatgagtttgattgtgaaaaaattggtgagaagtgaaaaaaaaaaattcaaaaatataaaaaagtatgataccttcattacattattttaatttaaatatttattttcaaattatcttttattttattctctttcatcttaccaaaccaatccttaaattttattatcatataactgtaatattatattcttataaaaggatgtagagcttttaagtgtcactggccatttatgagtagttagtaagatcatttagtagtttataagttattttgactagtttataagatagtataattaaaaaaaaaaatattttatataataaattatgatttaatgattgtataaaatattttataatatgtataattattttctcattttttattatatatccaccgtgttctacggtgaaggttcagttttaacaacgttcatcttaaaaaaaagtcattaacgttgcaattaatttaattagaatctcctaaaaaaattaattagaaagtcaacattggaaaaatatcagaaaaaaaatctgtaagaaagtcaacttaaccatctaagcttttatcttaaattatactattagaaaatatagttgtccaaaaaagaaaaacttagttaggttagctagagaggcattaccgaaaaccgacgttgttccttcctcgatggagtgtgtagtaagaaaggcggtgacgtcaaagatttgaactagtcactctctgacacaacacagaacccgatcccatcctttatcaattgaaccaaaaaatcattacatacacattaatgttcattcacacactctcttattctcatcccttcttcaatccaatccaattcaattcaatccacattctctctcgcaccgaaaaccctcgccgccgcaatggaaaccaagaagctccaccctcgcttctcgctcggccgccaatcctccctcgcgccggagcgcgccggtgacggcgactcgtcggagtcgctggacccggcggtccgtttgatgtatcttgtcaacgaaggtgactcggacgggattaaggagctcttggacgccgggagtgacgtcaatttcaccgacattgacggccgcaccgcgctccacgtcgccgcctgccagggccgcaccgacgtcgtcgacttgctgctccgacgaggcgcccacgtcgatccacaagaccgctggggcagcaccgtaatttcactctctttcgctcttctcgctgtctcttattctacactcgctgaccctaatttctggattggattgtttaacagcctctagttgatgccatgtactacaagaaccaccaagttgtcaagcttttggagaaacacggtgcaagacccccggtatgtctcttcttcttagatcttattcatttcctctaaaaataaagatgttattcatttcgagagattaatagatagatgtgcacttttggtgtggaattttttacgttgtctattaatcagatattactttttgtatgacttttttaagtagttattataaaaagtcaaacatatttatcatgaatggaaatataattttttttacgctgtctgagcatacatataattccagttcgccttatagttcaagcttttagaagagaaagtagtatataaactgacactgtacaaattttttatatttcattcaatcacaattcgtaataccatattgttgtgtatggtaggttgtttgatttacaataaatacgttatttaaagagaaaacacttttttgaataaaataaatagttttctgctcttttgatgtgtttgtctaactgtttttttcccttaaaaaagtagtactagttttctgttttttgtttaaaaaagtattttttacaaatcctatttgcttcttaaaaaagtattttttacaaatcatatttgtttcttaaaaaagtattttttttttaaattgcttttacactgcagtgtatttttttacactgacagtgcatagatattaaactccttttagtataggttgtttatgacatcaagttgcaactgaggactttttattgtagatggctcccatgcatgtgcagaatgctcgtgaagtacctgagtatgagattgatccttctgaacttgattttactaatagtgtttgcataacaaaggtaagctttcaagtttcctttctctgtatggtcaattgttttgtaacttgatttctccttttaccttgttttgacatattctctcaagtcaatttaccctgatttattttttgtttcatattttatattgaatattagggaactttcaggattgcattatggcgtggaatccaggttgctgtcaagacacttggggaggaattgttcactgatgatgataaagtgtgggttggtctacctatgcaatctgttgtttcattcatgtcaattactcaattggatattcagttctcaatttttgttctcatagtggattttgtttgttggtgtctgtttatcagaaaggcatttcatgatgagcttacattacttgagaaaataaggcatccaaatgtagtccagtttttgggtgctgtaacacaaagcacaccaatgatgattgtcacagaatatctaccccaggttagtcttggtcctacactggttatatggaagattttttatgataagttattttgcccgtggtgtttatgaacaaatcatattggttagttggctaatggctatcatagataatagtgagctgaataaaatatgtggtcagaaatttatcattttggatatagtctttggaaagaaagtgactagcgtaggttcaataggactacttgaaatctagcattatgttggaggcacaaaaaattaatacttaagaacttaatatgataaaagttatactgggactgatactaattgttgaagtgtcaggagttatttgcaattctgaataggccagacaggatttggccctctaagtgaaaaagtgagggattatctacaattgatataaagtcggttatgtatacaaaatgctttaattcaaattgatgattggtagattcttactttctcactttctcactttagaggaactgaatccggtcagacaattatgttcctgttctgtctagaagttataaatatctaaattgaaggattttaagtaatgataagagataaccattttagtctagtattgataagtgctgaattagaacttccatttatctttattgggatttcactttatgttagtgaaatggtgaaaaaaataagtgcatataattaggaagatatctcctctatttgtgtgtataacgtggttaactataccttgtatttttcactattgtaatgtctgacaatttggaatggattatcatctctttagggggatctccgtgcctacttgaagcagaaaggtgcattaaaaccagtaacagctgtaaagtttgcacttgatattgctaggtcagtcaagagctttcatattatggatgcatcactagctttcagttggtttgcaaggaagcaagctctcctgattatttcatttgttgaaaagttgaataattaatgaagattttctcctatattaaaaattttcatttggatatttgtaataattccaaaatatgtatattttgcaggggtatgaactatttgcatgaacataaacccgaagccattatacacagagatcttgagccttcgtatgttttatgttctcctgtcctgtcttgttgattttattattcttccagcatgtgtatgaagtatcgtggacttttcagtagaagcatgcatttttaattcattattgaatggttagaactgtttaaagtttcttcattgtacatgagtaagacaacagaaatatactgcgggatgattctgggcatctgaaagttgcagactttggagttagcaagttgcttaaagttgctaaaacggtcaaagaagacaaacccgtggcaagcctggatacatcatgtaagttttcttctttagtggagccctggatagataatgcaagttttcatctttactggaaccttgtaatattcgtggtcaatcatgtcggtctgcataaaagcaatattgtgaactcttatttcatgagggccgtaatgtgcacagtgttgcatattctgcaaggaaaaaagaaatgctgtctactcagtgactaccatagacagttgtcagctggtgctcaattttactaatttgaatttatcaattgatttataaatatggccatctcttatatgtataactggttttattttaatcctattgtaattggttctgatttcaaagtttgtattgatgaatttattcaaatctgtaacagggcgttatgttgctccagaggtatatagaaatgaggaatacgacacaaaagtggatgtattttcatttgctctgatattacaggaggtaaatcattattgctcatctttggatgcatgctgattttccttattttagagcttttaaatgacttccaagttaattatttacccttattatgtgaatggttgtatcttctctggtcttgaaacaagacttttaaaccctaaactggcaaattaattaataaatataaaatctgtttgatgaattgatgcttgtggaatattatagtggtattgagcaattaatacatgctaattcaatactctccgtcccttgtaatttctgtttatctcatcacataaaacttttaaaaggctgttaattgcatttgctttcttaaaaaagaagggaatttactttatgttgtctgtgctttttcagttatattttgagcaattaaaagcatttacataatcctgaacataaagtcatatcccctacatacatacatctgtgttgttcatgttagttaaaaaattggaagttcaggaaaaggaatgcattgagaggtgtatcatctgttgctgtgtatcctatgttgcttttggcattcaaattccttcagcattgttacgtcatattgaattttagatgtttgatggtgtcttttacgcataggacctctttcacttgtcaagtaaatacgtataggagtctatggacagctcaagcattcgtgacttgtgagctctgcctgctttgtccatcagataatcctaaagatatgtatattatatataattgtgatatacaatgctttattgcatattttaaggttgatctaatggacaggtagagttctagagattttgagttctccacatattgacccaaaaaatataaatgtttgtatatatgtgtatattcatggtcatttaagtaagatgccatgcccaacagtttgttgtggtaccaatatgttctcgtacttttttttttatgtgaagacaaaatgttcattttctgaaagttcaaaatatgattattttatttgtggatgatgggcaattttgtatatagaatatacagattgacaaccaactgtaggttgttatttgtagagatgcccagcaaaatattgacaggaacttgcatgattttctgttcctctagatgattgaaggttgtccaccgttttatgcaaagccagaaaatgaagttcctaaagcatatgttgaaaatgagcgtccaccatttagagcttcaccaaagctttatgcttatgggctaaaacagtgagggttttaaatacatttaattggcagcagatttgaatgtttagtttcaaaacctaccacaagtaggaaattaaattaataagtttttcacattcaggaaatttgatttgtccataggttaattgaggaatgctgggatgaaaaaccgtacagaaggccaacatttaggcaaataattgggagattggaagacatatactaccatcttgctcaaaagaggggctggaaggtatccctttttcatgtgaatatttctttcatcaatttttagacctagttatggtagtatataacttcgcagtaatttttaatactaaaacttaacagaatgtgaggaatttcagattcaaagactttttctgtatcattggatggatattaataatttttataccaacgtaattttactagattgactgtttttaatccatctcaccagtagaatgccctcaaaggtgtggatattgtgcgatatagttattttacaacgagactgtgtgattctttgtttcctaaggtgtaatattttcttgttatgatacacaggttaggactcctggatgcttccagaatctggaagccatatttaggggtaatcgcacaaatccaagtagccgatcatctcgctttacggccagataaatatttgccttgccatcaagaaccaataaattttttgatcatgcagtatcatatacttgcacgtcatatatatagttttttgtaaataactttcgctcgacgtgcggttgaataaattctgaaaagaatgtgacatatcattgtgtaattttgtccaaagacattctttctagttcttgcttataaaaaaagttagttcttttctaaactttatctttttaaaatattattttaaccttaggcatattttgttaagacgctgttctttttcaataaagaaggtaccatgtcgttgctcctattctcatgtgtgggcctcaagagaattgagtacctacctgtttggaccggtgaacagttttactttttaacactgatccttatgttatcttgtttgctttcatccatctatttaaatataattgtaaatacgaagatttttgctgcaaaattaaaacaacgaaaattttctttgcaatatagctaagtggcaatgttttgcttcctagtttcttcctcagtaatgatgctgctgcctatgattctgataacagacaaccttacgaatcagaatgcaggacgatgttgatggatagaagctgccaatgtcttttcatttgtcttttttaggaaaaactcaaacattttttttatccatttgaatcaaagaatttataataactgtttaatcaattaaattaaatccttttactgtttacacttaaaagatgaaagaatttttaaggaataacaaacaaagggtcattttgttacatgcaatcaaattttgttgtcttcttttttaggcattaattttttttttgtagtttctaacacactgatttttctctgtgcccgtttcgcatgcgcttcgcgcaccattggcgctttgctctcctcttattcttcattggaggttcggatggacttcgccgttctttcccaactaaaatagaaaaggcttcagaagcttggctagttctccttactcggacattctgttcatccgatcactgtccatgcttccaatttcgttgtaacgagatctagttctggagttagagttaacatcgattgttaaactccttttcggagagctcagaaaatgcagactcaaagtgaaactgtgttatttccactataatttttagtagtctgggaacacctttaagccgggatctgcttttgcaatgttttgtgcatgttcgcatactttgacctatctaatgtctaggttggttcagtgccattctgagggtttgtaacaaatgtgtccagatgctgctgcaactgcaatactgcaaacaagtctacgacaatggacagtggacatattaagagcattttgaccgttggcgttacctatttttatatttcttttttcataattcaaccttttatttaaaaaagaaattattagttaatgggtttgatttttttatacattgttaatgtaaatatttttataatgtcacgtggaaactaattaaaattaccttaatatcactttaaaaataatcttataaaaattaacaattttattatatatgttagtttatgattaataataatgtaattttttatgttatcattaattcaaaaattgataacgttgttaacttatttcatcaaaaatttagaagaaaaggatattcataaattgaagtctaactagacccttaaaaactttccacttgtaaactttgaaaaagaaaaatcattttagatatttgcattccatgagcctagtacattttacaacttaggttgggttgcaaataggactaatggatttcgttatgagtataaggcataagtatttattggtttttggtttgagtgacagataacttgatccccctcaaataaatttatgagttgtatatataaaacttaattagtctcttaactgtacaaagttctaaatttaaaattagcatttgaatgctaaaaatttaacaaaaacatgatccactgtaagttatccccccacagaagcatagcacaactttgactaccagaataccaggatgggattacctttctctataatttgtacccaaacagtatttttgcttacctgctagtaattaatttttaacaagacgatctgaaatctgaaaatatataaattcaaaatttaagaagaatcaatataatgtttgctttactgctcgcatttaggcatggacaatcaatgagttcttttaaaaaaattaactgatgttttcaaaaatttaattatgttgaaaataattaatatgtattctctctatgcttaattataaaaaaaaaaatatgtattctctatatgcttataaaaaaatatgtattctatataatagaagttatacactaaaactcaatacgtttggtactttttttaatgaataaaagatgatatgataataagtaatgatatatcaatacatcagacattaatttaaatatcatttatgttaacagtggatattcattaaactcaaaaattgaagtcattttaattttatcgctttcacatatatacaggtacttgaaaatggaagttgaatttttatttgctgaaggtttgttgctttctttttttccttactgcttgtttggtttaatgtttatcacttgtcgatcagtatttgatctcaagcaggagctataaatagtagcttctatttttctttcatgtcattgatgtgaaaataccacttctcaggtatttgatgtataacaaaacacaggcttaatctctctctctctctctctctctctctctctctctctctctctctctcttgttttcttgtttaaattaactgtctagactttacaataagcattaggcagcacaaaaaacaacacgttcaatattattatttttgcttcttttccaaataaggagtataaggctaaatgagatgaacttttgtaatttaaataaattgaatgagatgttagttaatttgattacgaagtgattttattgatttgtaaccagacctagagggagacatcaatcctgtttgatagttaaaactacatatcatatgatattctttcatttaggccttaaatgaaaaggataaatatatacgtccactcattgtgagataaactgaggtgaattagttttaaaaaaaatataaataagatgaaagataaagtaaatactactacatcttaatgagggttgaagtgaaaattagcattaccaagctttcccctcttattattctctgttaaaacttaaaactaaaagtgctacaatttcaaatttaatggtgcctcgtttctgaaacaccaatcattgtcatactagtgttaccttcattcttaattttcacacgtaaaattaaccgctgcaacaacacacacctgacaccattacatgttgcaaccgtatattctactttagtacgatctgaatcaaacagtgaaccttaaagcatcaccagacacaaatgaaaagaaaaagatcaatataactaagtagtaataagaaagacaatgtcacttttgagagatattaataatttaattaatttgatacactgatctttatgctattcctatcaactaagttagacattatttgaataagatgtttgaaataattattacaaaagttgatgattttcaattatatactaaaaaccaaggattaaataaaattacactgtaaaaaaattcattattaattaatatattataattaatttctaaattatgttcatgagccatttgtgtacctgagaacaacacaagcttggctcagaaacaaacttaagtggtaacaaagaagtgaattggatgtgtaggttgagacagatatcgaagctagctaatatatatctaattgctttttcttcggttttggtgtctcatttgtttgtatatggaaattgttaacttcattcttagttatcatgtgctcacccgcatcttaaacatgcttaatagtattaaagtgaagaattactgtttaagtaagtaagaaaagtgtgtcttgtggagagtgaaagagagaaagacgtacggtgaaaggagggaacctctttgtctgtaggcccattttggcttacaacttcctatttgagtgccattttgggagctgtcttagcacagttacttttgtctccctcttaattacctggggttgtaattttgtaaatactctttttgatcttttattacttcaaattactctatgaaattacactcttttatctatttcatagatgttttaactataatactttttattgtcaaaagttatactatttttttttcaagagataggtgttcattttattgtaaatgagtatttcaccagtaatttttcttaattctcaattcagctttattgatggccaatttttagacacctactatcatttgagacttcataaaataatcagtttgaataaacttttaaatctgacagtgaaaaagtgttcagattttcattttcttttgaaatgttaaaagtcaatagtaagatgctcaaaactatttgtcactgattaaaacttagataaaggaaaaatggtcctgtaattttatttataattactcattatttgaactcttaagtataaagaggagtcaggagtataattaggacaattaaatattttattaaaagtattttttatcataatatactttttacctacaaagaaacttattgtgtttgaaatcacgtgtgtgaactgtattaactgtggaaaccaaatccaataacccataagaggcataaactacaacatcttgcttctgaataatgcggatctgggttgacacaatgcttaagtaaacacaacttaaattaattaacgaaaagctattgatcactaagtgcgtagattaattgatggaaattgttttaaagttcgtttgagatccaatagttgacataggcgaacatagatgacaagttaatgtaaccaattcaaattttatactacaaaagcaaagtaaaagagtttgagtagatcattagctacctcaatggcatttcgtgcgtctgacttatttttctaatagatagattgcagctagctgtcacaatatgttgcatatatagcaaatctgagtcatatgatgattaagatgaaaagtttcttaatatcacatgaccatttaaaaaaatgacgttagttttatattctaatcttaaccatctataataaaatccaatggtcaataactcaatattcatttctcttactcttgcataaaaaacttacttttatatttcctgtaaatgtatataagattgtaactttttctaaggggaaaatttactgttaattcacaaaagtataaataaaaaataaaagtatgactttaccataccataaagcataatgtgatgtgaaaccaaattaatattatcaaaagataacccaacttctttgtagtagttctaaggagcaagtgagctactacaaacataaaatctcacaacagaaattaaaatcagaacctgcagcaggaaatttaaaacctttatagtgtaattaaaggcagcagcaacacagcctaacagcatgaactatgttactaacactgaaatctaataggtttagatgccaacaatttatatcataacgggcaagcacaaccactcatgactcattcaataagctgttctcatcaaactagtagcctagaacctctttccttcaacctataaaagctaaataatcaggattacaattagtgcatcgagtaacacataatgcacaaatgtgaatgaacatacaatttgtttattgagtaattagcgtgatcagatttcctcatccagaaagccacctgtcttatttcttatatatattggtgctgttcaagaatgaactaacagtgttatgatattaccatgacaaatttcaactaccaccttgtctctccttacatatcatttggtagtaatatagacaaaaaccacttttaacttttaagcacaaatgagtgcttacacccttattaattagactcaatgattttctgtaaacatgcacctacagaggttttctcatgcaaaaagttgacaggatcacatcagcctcataacaagtacaagatatttgtaagagtttatcttcgaccaattaataaattccaatttacagatgattcctctcttcgtttcgttttcatttttgttctccaatagatattccttactcattaattcagcaaaatccatatatatatatatatatatatatataaatgaatgtcttccttgaaggctccataatccttagcatgatgaacttgataattgctatgcatacttagtttgtgcacttaaatgacatagcaattatttaatttcttctcttttgatgcttcttttgacttaaaaagataagaatttagattcttttgagtttttatcttaagaatgctaaagttagtaattttacaatgttttgttctattttgtagagtttttggacacatcaacacaagaatggaagatgtatgaagaatttgagcatcgcgctcaacatgcctcagcgcgagaagccaatatcatgcatgagtcctaagtgcgcaattggaggcttagcgcttggtcacttaagtcggttggactttgcatgtgcgctcagcgtgcacatgcaggtttagtgcacattcattttcgaaaaacacgaatgtgcagcattttgaagaataaaaaggaggagcactgtactattaagggacaaatagtaaggcacaatagggaacgaaaacccactcacttagagtccttcttcttctatttcctttgcttcattttgtatttctgagtctctcatgactatgagaggctaaatcacccattgttgggggctaggcaaccaaacactcttgatgtgatgatctttactaaccattttatgctattttaatattattgcttcttttatgagtttattgtcttgtttatgatttgatcacccattcacatgtatgttatagggttttaatcattgggaaatgtttgtaccctaagaacttgaaggagcttctaggtaatccatgtttagggataaaatggtgttatttagccttaattatgcatctttattcttaaaacaaattatttgatgtagttcttaagggattaggagtgaaattaggtaatttaggctattttacatgaggaaacatggttagggtaatttagaggataaaggtaatagttggaataacgttaaatggtgaaaaatctctaacattgcatcaagagtagtttcggtaggtcgaacacccaacacgtccacaaaaatctgcaccaaacgacaatttacacctccaagcatttgtttttctgtctcttgcgtgtgctctaccttgttatctttatttacggttgaattttgcatgtctgcattatcacttgacaagtatatagtttagtcatttattagtttaaacttagatatatacaaactctgagtatagttaaagtctatgtggattttgacactcggtcttaccgttttactactacttagacgaattggtacacttgccaagtaattaacaaaactgaaactcagaagcattcagttcttgagctactacctcacaataaaagaaataatgctcaaacaacaaggttaatgtttctttcacattaattggaagtcaatgcttttgcagttcaaaaccatacggttagcaaattaaagaaactcaacaaagtttattttatatctttggtcccacaaaaacttggtataaacaaatagcattaagtaactaattaagtttccccaattaatagttctcatgctttcgtttcattttgctatatccatggatttaatgtcataaatcatcaataactagatctctggaagatccttttacacctaaaactcaaacaaatagttctcattagtatcttcaagtctctaaaatgttgtttgtaatttaaaagcaaactctaacatcaaggtggaattccaccttatttgaacaccccagacacaagtgatttgcttttcatctttgtacaattcgtcaaatttttaatctcactatatttctatagtcaaattaacttaagagttaccccctccttttgtcaatactcagtaggtaacaaattcaccataatcctcttgtggactgtgtacttctttatctataaagggggaaatgatgcacatataattaaattcagattttgcatccacgttcagtccaacaatcagtagtaaggcttacattttgcaaggtaatttacataagagataataagccctttcttatgtttttatttatgaaaattttaaaactgttcccttgctggttgtcattgtacatcctggatggaacattaaataaaagctgaacaacactcaagttgtatctaaacccttctgctttcacaaaaacctaaagggtagctctttcatgattgctatcctactcaatgccctctcctgcattaattgttcattcaattatcaaagcaaacaacaaccatctccttcatcttttctttctgggtggaatgacaacatggtttacttatgaattatgatccccgaagagcttcagaaaaaatctagcattgcctcaataaataaatgccaatcattttttaatttcttgttcctgtctgaagcaaacttaatctcatgcatttcatttgtgacttatatttatatttccccattgagaaatgtctgtcagtaacagactcttttgaatatactctttattatggattaaaatttattcaaaactcacaaaactttgctcatctgcctcaatcataattttgtagttttcattaattaaccataaattaaccatcgtatagggaatagagactgtattgctaacactcttctaatatcccccatttgaatgcataaaacaatttcagaaaaatattccatactcatgatggaggtctagttggaatttcttgttaccttcttgctgtatattgtgttgcagttgtttgatcctcggacttggttgttgaggtttcaattaacagtgacttggggaccttcaattctcttggagggtgcttgcctgcttggactgtagattctgtttcaacaaccttcaaaggttgaatatcaatctcctccaacttcttcatcagccaggatcagcaaacaggaaatgatttcaacaataagatgcacttgaatctgatcctcaatctgttacaggaaaaaaaaaaaaaaaaacacatcattggaagagaaaggaaaaaaaaatcaactgaaaaaatatccaaaatatggttgaagtttcaaaaataacaacaaatttcaacccaaacacctgacacctgctttgctcattttgggaatgaaaatcagcaaaccactgtgttacttcctactcctcaaacaaaaattgaaaaaaaaataaaaaaaaaaaaaatatatatatatatatatatatatatatatatttaagctcttccagaaaagtgctgagctaaaacagcaagtccatatatattgttatcaccaagtccatactccagccgaatttaaattatatttcattttctttactgaaatgatcccttgattaaggattgggggcaggtatcataataaaatgagtaacaaaaaatatatatcatgaatcatgatatcagtaagtaagttatatatgctaaagaaatagaaatatataaaatagaaaatgcatggaagactttccaaactagaataaagactaatttgatgaaattatatattataatgattataggcacataccagatgagtgaggaggattcgggagtgtagagggaaacagagaggtaagaactgaaaattgcatttgggtgttggaattggaagctaggcatgatgcaaacgaaaccaaactaccaaagtgagattagattagaattagacagaaagagaataatctgtgcactacacgacacgaataccattatcattagtgggtgggtcctaccttcttgtcgttttctttgaccgcatgcatctatgatgttttcagtcacttcgtgtatcattatgccagattgccacgccccaactatattcttcacagtaattatattcaaataagaatttataaattatcatataaaataatagttcatactttttatcataattattttaaaatttataataacagtgatatttgataaagttaaatgattaataatatttaactttatcaatacataattataaaactctcaaataaaatataaatattaaatttaatattatttaacatgtgaattaatggacagaattattttaatttaattaaaaaattaaatttaaattttaattatgcaattgcaattaaattaaatattcaaaaataattattaaattttatttaactcgaataaaattacttcctacaaataatactcataatattataaaaaaaattacatcatcaatcaattagaaaattattataaatataactttttgagatacttattaaaaattaacaatttatcatgattgagtgttcacaaatcatgaaatattttggattcaatatggtttataaattataacttttatgtaataataatattttacttttagatcacattataattgatatttaaagttatatttactatcacccaactataattttatctaacatatttatcttggaaaaaaaaaaaactctatctacctgaattaaatctgagtgtgtttatggtttggtctaaacatgctaaaagttggtaatttgcggtgtacgttactttaaagtttaaacaaacaaaaggtcttaaagtcaaaatgatgcgcgctgcaagaaactgtgtgacactgtgtgtgtgtgttagtgggggcgcctcatattctaagcatcgccacacacgacaccacacaactcgtccctttcacgcgcttcacgatacttccattccacgtcttttcagttctcaagaatagtatctacaaagttagaaaaaaaaaatagtaataagatatttggaataaatgatcaatttatccctaaaaaatagaaataacaaatttaatttataaatgtataaatattatgataaattggttccgtcattaagtcttttatgtttttgtcgatcctcgtgtacacgtgacaccttcatgaggtcaagtgataagacacgtcggatattcatcattttttactaaatagtcacctaatatttgacttctcaaaacatcctgttttggaccaaaatgacagttaatgtttggctcctcaaaacacaccttcacaagtcaaacatttagtgacaaattagtccacctcgtgaactacacctacgtcatcggcatcatcgtcacataccaacacaactatgtcaatgtctttgagtgcaaccaggttgtctgcattgtcattacgacctatcgtgacgttgatgtcacgccagagaagcttagccgcaagtatgttgagatcttcatggcccccgacattgtcctccacagcgttagcaacacctgccttgtcaccatgcacaacaagagcatcgccaagataatccactctgccatcgacattgagaacaagatcctcgacgacgaaacctggccctccatcgaggtccattccctcaagcaccaagctagcatcgatgtcttctccaacgctgccttttaattaccgtaagagatactcaagggtagtgacgaggtcaatgccaacctcgaccccgccaagccctaagtgacattttcgtccaaaacggtgtgcattagacgtgtcttgtcctttgaccttatggatgttggacttgaggaccaacagtggatgtgccacgttagttacatttgtgtcatgtgtgcacaaaggttaatggaaacagtaaagacttgatggtcggactaacttgtcacaacatttgtacatttgtggactaaattggttatttcatatttcaaggatcaaattatcataggatacatctttcagggaccaaattggtcatttacccatagatgtgggctttcttgtttcataactatttatgataggtaaaaatagtttttatagctttttgaaaataaatattttttaaggaaaatgttttctagacacctaatgattaatatgctacccaatatctagggagcgaaaaaaaatataggtatgataagatttatgatatcataaaaagatagagatgaagagaaattagaggtgttaatagaatgtttaaaattatgagtagttcatgtataactactcttttttttagggtaaatgaccaatttggtctatgtattttacactaattgtcaatttagttttgtactatgaaaatgatcaatttagtctacaatcatgtaaatgtattgacaatttagtcctaccttcaagtctccttcatttctgttaacgtttttggcaatgtggcacatgaaagacgacgtgacaaatccatgtggtggaagtgaaagccatgtgttggaccaaattgtcaattggagtatgtgtgtgcttttgccttttattaattcaccatttatcctcttcctttttacattttgtaagaaaaaggttgaattatgggtgctaagtttgctatgctctttcttgcctttgcatcatcgatgcccatgacgacttggcgacagatggtggtgtttggttggcggttgccgtttttgtttgatttcttcttatgcgttgaagatgaaaggcaactccgtaaggaaagatgttttttttttttttggctggactttattaatgacctccatttttgtaacatttctcatgtggccatcatttttgttagatttcttcctattttttcgttattgtaggcaaacaagggattaaacatgtgttagggtttagggtttgtcgatgatgctttgatgaactgaaacaatgatgctttgttttgggtatgaaaaagaataaatattattattgatacaaagatgctctgttttcttcttcttttgactctattttgtgtgtttccttttactgaatgtttgaaaagattaacattatgttatatcacaaaggtcgatttgttcaaaatgatgaaagggtgttggagtatgtacgtggagggtgaagaatgttattgggactctggagactgaccttatgtatgttttttactatctatgatacatgtgcgtctttaaattcacaatattgtcatgaactattttgtcgttaagttatattcgttagggatcatgttgtcattccaaaagaaaatattatcatgaaattagaaagaagagtcatcgtgttcttaaaatagtcattacctttataaattttaaaataaaaaaatcactaacattttagtctaaaacattgtggttgatgtggagcatctcctatacatgtggatttgtcacgtcatcaaggatgtgttatgttgacactcaacattaacgaaaacggatgaaacttcacgataggattaaattgtcaatatatttacacgacgaatgtaaagtacacagacaaaattgatcatttatcatttttttatgatacgatggtagtttttattaattatttttaaaattaaaaagacaaacttatttttttcttcttattttttaacctcgaactgtttttttaataattggaattacaaattttggttctccaatggaatctcaaatatctatataagtttttgattttttaggataactatgaaattaattcttaattcaaaattgaaatttatttaaaaaattataaaagaatcaaataattccttgttttcagtttaagtctagttctgtattgtaaatccaaaggctcatgttgaatgagaatattttaagaaattatttttctaccataatgtttttagaagattttcttatatgcaagtgtttttagaagttaatatcgcattcagtgaatcataatacagtgaatcataataggtcttatcttaatctcgtataccgaatatttaagaaagtataaataaaaatgagaatatagattaacaataaaataaaaaagtttgtattaaaaaattataaattcatatttaagaaaaataataaataagaaaaagacaaaaattattttgacgaatcaattaatctcttactcatcacaactagttgattatctggagtgatctcgtcaaaataattaataaccatgaagttagacaatttttttttatatatatatgcactaatacacacaccttattcagtgattttgaagaaacattgtaaaaagtattatggtcaattaataaaaatgaaaactaaatttgtaaactaacttacatttttagaggattatatacgtctttggataattataatgtacaatttcttcttacaagctagctttaattatcatttatcttaatctatatatctaaatttgtccaatttagatgcattctatccaggtatattttatgtacaaatgtccagattgaatacatcttattcaactgcgaccaacctgcatgcgtcctgtcttagaccatttctttttaaggtctcgatcgagtacatctaaagtatctaatcaaggattaagctatgctttaaagagtaatcttagttcacttagatttttccgtgcatatattaatattaaaattatttctattaagtattgcagtgtatatttttaaaaacgaatttaactagaaacaaatatttaaaaataaaaagaatcaaagttattgagatagttaatggtgagtggtgtggtgactatcgatagttgtcaaaaacagtgataaacaacagcatcatatttttttttcatgtatgagtttgtttattctttctcatgccttgtcttttattttcaatgaataaaattagatggagagaacaaatttaactttttattttatttaactataactaatattttaacttccacgatgcacaagacaaacgtttatttttataatatataagtaggttctctctctcttttttcttctcattttttaaattttacattatttttactttagtttttatttatatttgtagagagaaaatttataaacaacagcatcatattttctttcatgtatgagtttgtttattctttctcatgccttgtcttttattttcaataaataaaattagatggagagaacaaatttatacgagaaaaaattaaattatacttttataaactactctaactcttgcaatgttttatatcgcttttataaacataattttttgtttaattatttaattatgtaattattggaaaataggagaataattgtgatgtgacaatagtatttgttttgaaagtaaattttggccttgatccagtttatttttcaaaatttacatagtcatgtatgtaggtttgtgaatttaaagaaaaaaagatataaaaatctcataaataatgctcaaaagattcaagatgataagaggaggataaaaaaatgtttttttactctcaaaattgaagttgtcaatccttataaattattttaactactgataagttcttttaaaaaaactatttcattttaatttaaaataatattataataggatttgttgaaattgataaacaactaggaaagtaaagtatatataaatagtaaagtatatataaataggacaatagttgtttgagataactttttagagatagtatgtaaaatgcacatttaaagaagcgcaatttttttatattaatttcattctttaaaattaaatttgttgcatatatagttggtaaaaaaaaatcaaattcaacaaattttatttttattaataactatgggtactaacccataggctaatgcatgctcccctattctaaaatgtatcaaacttatcttgtaattgggtctcttgtagtggactttattataggtattcttgattatcatggactttcaacgttttaagtcaaagtagatcgccttagtgatgtaagcctctaaaatttactctattttttatattaaatttaaaattgtaatcatatatgataattgtaattaaataataatgtaaaatatttttacattattagtgtattctaattattttaaaaaaattataaaagttgcaactaataaataacaaatatattaacttaaaaattaataataataataaaaactaacaaaaaaccacaaaccaggcattaattgcgatttcgaattccttccccaatcaaaatagttattcctttcttctaattgcttccttgttgcctccctcaccatcataacttaattgtatgccatggcctaatttgattgatgaatgaatcaatggatggagttggactcatatcgaagcatctctcagtgaacttgtaggcaattatttagtttcaaattaagtaagtaatcatcaaatatttaggaaaagtaaatacaatgtttaaatattttgaagtgtctcaaaggacaaaacattttcatacgaagaacactgatatacaattaaacaacaaatacgaacacccataaaaatttgatgactaaggggtttaattttacgcatgaaaagataaatatgttattttcttcgaaaaaaaagataaaaatgttcattgctcaagtatatgtttttatctgtaaacattaaagacattgtcaaaaaatttacaacaattcatgttattgtttaaccaactgagctagactctctccacagtatatttgaatatgtattcctataatttattttgaatcaatgtaattttctaaaattgattcaaagtaatttacagtgatatgattttttttttttggataaaagatatttaaaaagagactttaatacacaatgttttgtttgaaaacttgtactactaattaagattgattttgagtatgtaattataaaaaaaaaattaagtctaattaaaggtatatttagaacagatgacataattaagaatatactttagacaaatatcgtgactcgaattagtattaatgtaaaaatatttctttaatacttttaatgagacttgagtctaaaatttataatcatatttttaatacaatgtcaaatatcatggtaaataaaaaaaatatttgactcattatatattcaagttaaggcatgtcaaccaagaattcaaatacagtcaagagtacttgttttaatatctttcttgataccttatattatcgttcattttttttactaatgtttcaccttttgtttggatgagaaaaaattaaacgaggaagaatagaaactttcaacatttgaatgagaataatttgttacttgtttttcttcctatttttcagatacataatttttttttattccctatttttcagctctaagaaggatgttttatagcaccaaaaagaaagaaagaaaattcactctatttctcgtgataaaatagtttcaaatagttgaatatttaatgagggtggtgagtgtgttttgttttagagaggttgagatttgtgttttcagagaattatgaaaattgaattaaaacaagagacatatgtattgtaagttgataagaattggattaaaataagagacacacaaattataagttcatggtcaatgcaagatgtaaggagttgtcgatcggcagcaaattattatacaaaaaagattatgtcgtatgcaaaattaattataggtcaaattattatctgtttctttgtcatttttcatcttttttacacggaaagaaatgtgattgaggcccgccactttattttaatttattttcaccatatttcataaatattaaattgacttttgttgttatatttcatttttaggcctctttctcgttgtttcttttgccatttccttgccaaacactgagaaaaagtgactctaaattaatagtaaaactctagaaatgaaagtattaaaagaatattgactcttattgttctctcctatatcacacctctttcttaccgtttctttgtcatttgttcgtcagcaagtagaaagtgaaagtgaatataatttcataaaactcaagaaatgaaaatattaaaagaaagaaagaaaattatatttaattttgctagtctatctgttgttgttacatctctttctcattatttctttataatctctgcccccatgaaatatgaagcaaaagtaaatctaaattagtagaactcaaaaaatgaaagtattagaagaaaagaagaaaaacaatttttcttctgttattttctcctatctgtacacatctttttaaaaaaaaggaagaaccataaagattaagtagtaattgaaatttgagtttctcctaaggtagtacttattatttaatgtataatgtcacatgatttatgatttagttctttttcttattatttaagtggacctgaaaaccatgaaaaataacgcgttaattgtatataaaaaaaaaaagaaaacaacgtaagtaatttggaaactatttataataatatattttttaaaaaaagaagtgatattataatggtagaaagcgcgtggattggtgggtgatcgcgtatggtggattgtttgtggtcttatggtcttacagcagaatctttgtttcatataagtagacgagcgtgggcatataacactacaaatctaacattagcatttaacaaatactaccatacaatatacattatacgccccctttaactatactatcatttaaatacatacatcgcttaaccttcggcgcagcacccaccagcaaggcaacacacacaattcgcaatcacttttttttttaatttttttttaagatgaaaataatatgcatggaaagaaaagaataaagcgcaagagttgattagcaataataaaataattaatcagcgaaaatcaattacagtaacaagcaccaacattaacattataataaaacatgagtgttaattaaataattaataaaatattctctcaccttcgtttcttctgtatctgtcgtctctctctctctctctcatacgtccctatcagtcataaattagggaaaagcaagcagacagctacacacaacactctctcctattcctcctccttcttctcttctggtgtgagagcgcaaaacgttgattactctctctctctctctcatctaatcataatcatcgatgttcctcttttctcagtcttcttcttcttcttcttcttcatagtctctcccttcttgtaatcacttatcatggcggctacgtttgatggattctccataaggtatatctatttttctattatctattgtttgtggatttggttttactaatatatagaagcgcgctttataggttttgattcggtgttgctgttgcagggactacacatccaagatgaggtccatcgacgttttcaagtgctggccgttcgcatccacctcctcacgtgacgtatcaccagaggaggttcagtcgtggcttccgccgatgaacctgtgccctagatccggcgattccaacgaacgccgcgttcaaaatccggagattccgccttctgctccggaagtttctagaaccgatgacgacgacggcgacagagattgcagcgaagatgaatctgcagaatctatggaatccgagaaatccgcgcctccttccgactcctcggcggcgaacaacaataacaacaacgaagacgagaaactggagatggtttgtccggtgtgccgcgaattcaacgccgcgacgctcacggcggtgaacgcgcacatcgacggatgcctcgcgcagacgatgagagaggagcgtcgccacatgaggattatgaatttgaaatcttcgtcgtcaaagtcgaagccgccgaagaagcgttccatagccgagattttcaaggtggaggagcagccacatccgccacagccacagccacagccacagccgcagcctcagccaccgccgcaaatcgagagggtgttgaagttctggccgttccgcgagggcgaggcggacgatgtttcgattaccgttacgaagttcgagtggctttctcggcggctggaggcgctgagatccacgcgcggaggcggcgagtcggcgaaatcggaccaaggagattcctcggaggagaagatggagatggtgtgtcctgtttgtcgagatttcaacgccgccacggtgacggcagtaaacgcacacatagacggttgcctcgcgcaggccgtcagggaggaacggcggcagatgagaaggtcgacggttaattgcaagcccatacctaaggcgccgaagaagcgctcgatcgcggagattcttacggtggcgccaccgatcgaagccggcaaaaggaaagcgattcaggttgaggaagaagatgaggagaaatccgattatggctattcaggtggagattcaactagtgccgccactcctgctgctgttgctactcccgttgcttcggtaattaagaacaagaagagtacgatgaagaatagaaacaagaaaaagttgaagaaggtgaagaagaagaaaaacaaggtggagaagcacggcgatagtggtgtgtggttcgtgaacaatgagaagcagacggttgcgagcaagaagaagaagaagaaaaaaaagaatgtcttcaacaacggaccaactgggaacaaggtatgtggtttgtgtctcataaaatataagttaatcttccgttatttgctgtgtgtttccgcgatttgcagctaattcctggcagataagtatacaaattcatggaatttgcgcataaaatattacccgacactgtagaatgtagattttgggttgatgtagtttcttatgccatgggattatagctttccttactctatgtcttgctttttctgcataaaattactgctgaaaaagctgattagagagagagcttcacatatttgtggacgaaagtgagtgtttttcttttggttgagtacttgagcgaaatacgcgacaagtaaaagttgggaaaagagagttacgaaaaaaggaaaactgtgaccagtgccttcgtgcgcggaagggattcagaaggtagtgaagcctgcaagaatgttgctccagctgtagtgtgtgttgtgtgtataatcagtacaagtaccctagctagaaggggccactcatgggttacgaggtagaagagagagctgagtctaatgatgaggggtttctctagccccgtcactattaactaataatttgggggggaattatcgtatgtgccatgggtagatcaacagattctcatgtatctcttgtggccagtttttcggacgtagagaggttttatacgcagcttacagctggatgtattttggcttgtgggagatctgcaagtggaggtccagaatttgatagatcatttattgggtctgtcagaagtgtatatttagtgatttggattgatgaatgttcgcatatgcaatttccagatgggcatgtatcgtcaaaaaagaatactctgacttgggttgatatagatcattatcgcatgggcatattttatggcgtattagtgaagtagggggtggtgatttatggtacgtataatggttttggactttctgtcgttgtgtgagacacctgattttatattgtgaaagtgttcgtttttgggtagaatgacttggatgtatcggtcaacataagttagcgactcatgttttgaacatgtgcagacaattttgagataagatctaatcgatgtgagtgtctattagaacccaacctaggaggtgtatatagaagcaatagaaaaccgaaaccaacgtcagtttgtggttacgctggccgaaatttgaaagtggaagtaaagtagtcaaatatttaacttggctagccatgaaggttactcgatgatgatataaggatgatatgatcttgcagccaactctatccttagaagtgaaatttataacttgactgtccttactgtatcagtaatggcatcttattatagtgtctagattgttttaaataacgtttctagactaatcttagtaaatactttattatccaaaaataattctcgaactctggttctatatttttcctacctaccatttcttttacaagattaaaatatattggattttttcggcattcagattctaaagaaatctcaggtttcgaatggggttatctggaccacgtagatttctacagaggtgtatcatatgtgatatgtgcatttctagtttcaacagtgaacaattacatagcagtctcaaattcatgtaaaaaaattatttaagcatcatgattcatgcatttgccattgtccatcccctccccttttaatagaatccaatatcccactaatttttaaaatttaatttaattaatttgcattttaaattgcctttctaaaagaacgaactaagtaagatatttatcgtataaatattttacaataataattttaacctcatggtgatatcgtttaatttcagaatctgtaatagttgtttgtcctaatactatttgctacatccatgcatgtgtttttcgttagcttcttcttcgtataaacaatgataagaatatatatgttgttatagaattacactttggatatgatattttagattcgcaaagtggcattgtagaaggtagaaattttgttacaaaaagggttgtctttacaattttgtttattttatcataaagtgtaattgcaccttaccggatttttaatatcttaatagcatataattattttacgccccagctttcagttacaacgaaattaaaaaaaaaaataatattcgttccaaattctacaagcttgtttagcgttctgtttgttaagtaaaatcaattttagggatttgtactttctatcaacacgtaaaaattatcaataaataagattttgaattgaagctctcatgcattcttcatgctgatattcatatatataattatacattcatctagcttgatatatggttatttcatgtatattcactcgtaaagatttaaaaatagtagtatatttgtaccagaatatataagctcaaataaccttgtatttattaactacgagcatttctgggatgtattgattacaaaaaatttcaattgtttttcttagtacctaagtttattttatggctacttaaatatatgatctacgcatttatgatatatacatatatagatttctatgtttcccttttctgaaaattgatactaaaatgaccaagtttaagaattttgttttaagcgtttctgaaatttcttatcatgataaaataatgatataatttcgttcttaattcaattgtttcaattttataaacttctacatgtagttgatcttaatgtatttcaatttgatttgtttttaaatgaatgatggagtacttaaaaccccaattaaagtgttattcaaatgtcactaaagtcttttcctaattatagaaaattaaaaaaatttcacttaataatcaaagagtttctttatccagaagtttggatcgtgattttataattaacgctggaaatatagtttgtatagttccctgaaactttccatggtgaaattgttcttttgtattaaatctacttttacttgaccataaattccatttgaaaacgtctttgccgttttatcttatgtagacacaagatataggcatgaacgaagttgcctcaatctttcacaaaaagctttttgatgagggacaagaattataaaaaaaactgaaaaaccaatggtctgagtaaacttttagggacattcatctttggacatcaagttattgtaaattgtaatgtagcaacagtcatagacaattgaaatcctttcactatttctgattggaattgttgaaaggatatgaaatgctaattttctacagtgtctgtttcataaacagacattttggcatcattatacatgaaactgttgtaattttgtttattttcttgtaaaaactacaacatgacatccataaaaaagaaaagaaaggagaaagatataaaagctacaggctacaagaggtgttattatatttatcttcatattttgcatatcctaaaggttagtcggcttattcttattttattataatataacattcataattttattaatcttgtctatctcaggatgatgtttacgatcgcatggtgcgaagtgcagtaaacagttccagaaaactaaaaggtacaatcggtaataaaatgcttccacttcatgaggttgatccttctatcgatagaaagaaatcaggtataaattgcttatcggtaaaaaagaagcaacaagttaaaaactgggactcagttggaaagcaagaaaaagcagtatctccttttcatggcattcttaagaaccgcttcaaacatgtttctgaaaagacgtcaagtggcagtagtattggagatggtgctcaagaaagctattataatgatcaagaggcaacctcggacagacatgtgaaattctctggcaaagatgatatacttggtccaaaaaagacaaattcatttgatgaaaccatgttcaagatatcttcagatgcggtggcatcttcagtagtaaaggagaaggcctctggaagtgatgaagaaactgcaagtttggagccaaacagaaattatgaccatattgacagaggcaagagagaggaggtttgccctatagttgaaagtaaacagttttctaacactctggaccaagataccgtacaaagcttcttgaagccatgtatcaatcaagagaagtcaaaacagttagaagagaagtcagaattgttgactaaggtggcagtttgtgacaataatgattcacagtttttttaccgagggaacagaaataccctgcattgttctccgtatgctgacatttctagacctctttcagcagtccaagaagagcagatgtctggtataaatacacagatgtgtgaatctggatctttcagctacagtgggaagttcaaccacttggatgatccacaggttgatgctgttaactcaaatgaaaatacaaagacatttctggagccttcttcatcttattctgcttcatataatgcaaatgaaaaaccagaatcttcattgcaaacttatggagataaagataacagtggcgaggccttgggtaggcaattttctcgtatgttttctgcagatatgattgataactcattccccaatacaggctgggagaaaggaagtggcaaaaatagctgtttggatccggatttttttggtttgccactcaattctcatggtgacctaatcaatttcagttcaagtggaaacttagggatgaaccagtcagatacatcaagtacgttacgtggttcttttagtggcttacccattaataatattctccatcaaagtaaccaggaaaatttaagcattaatgagaatcatgttgttcagaagacatttccaaaagatagtcttaatccatttcctcatcatccaacccaattacctgtcactgagttacaatctagagagagagaagatatcaaccgacctaattcttcagatatgtgttccagtcactatgtcccgccacttaattcagagttgaactgtaagaaaaactcgttcattgaacagaatcaatgtgaccgggtctggaatcacaatggaaatggggtgatttctctgaaagaaggttcagatcatatctcaccaagttccagccaactaacaatgaggttgatgggtaaagatgttccaattggtagaagcagccaagagatgcaacaatttgcagatgtttggcctgatgaggaatccagaagaaggaattattctgaatatgctgctttagatcactctttattggaaagaagttctaagcaggaatgggtatctggttcacctatacaaatatcagctgacaatgtattgcaagcagcaaaaattcaaagcaatcaagcagcacaaggcaccatattgatgagcagtacagactctggattctctcaacagtttattggtcggcaaagtaatcatggagtcaacttcaatgccagttcttatttcaatcccattactcaaaagtctacttatgcagtatttaatggtgcatccaatgacttttcagagcagtttatacctggagctaaacctctaggaactggcaattttagtcactcgactcatgtagccaatggtgagctgaatgacaggaacaaaaatccccatgttacaaaatcagcctttggaggatttcctttcttgcagccaactgtgaatgaacaggccaaaacatcttggtttgatagtccctacagaagttcaccatcgtggttgtcaatctcaacagatgaaatgctaccagggatcttttctcggcaattttctgcttcaagtagtcaaaattttcctcaaaatctgtggggaaataatttcactacgccatttgtgaatcattcagcagaagttcgctttccttctaatcatctgacttcttctctaggtcccatgcagacgactcctctttctccagtatcaattggtcatccactacatgttccggttacaccctctaccataaatagtggtaatataaacataaataaggtcgctgacagattgaagtttgatgaccatcagctgtgcacaaataccagaaagagacctgcagctgcagccaatcttgatgattccagaaaacctaccaagttaccgaatatacgagtgcaagaaaacttcagtcgtatgactaggttgcctggagaaaagtcaagcgtggaattgcaacgaaacacaagagcacttgaactggatccgcacatgggcagtgctaggagtaggtgttgtcagcatgaggcacaaaatctaaatcctggaagttatcctgctgtaaattcttttaaactggacggcatggtaacatcaggtcctgtccgacttggtcctaaaagagcgaagcacatcttaaattcctcttaaaatatggatcaggatgacaagctattctgccatattctcacctgcgattactgacagtgttagtgatatagaaattcagagaaaattgactaaagtatactgattttaggtgtaagttatatcattttatcatatctgcttttcctcctccatagtatatatccatttgagaacataacaggattgtccatgtatcaatattgccaggttgctgaaaccggtggaaaaattgatataattccatccagtctttcgatacatccagctctcagttttgaagtttatgccctttacagaattttgtctccaatgaataatgacgctttggatatctatttttgagccaggtattccccacatggcatctgttcaatgactatgcaaagatgtgcttattactgatacaccagaaaggaaagaaagatgggctttaggataagggaatagtccatctctcttaacctattcaataaaacttgaatttggggctttagttattcattaaccattggatacttcctcattaatttgaactggcaaattatgaagaaaaaaaaattctaccataccggctttgattatttatgaaaaaattattatttttcatttaaaaacttctaaaaaaaatatgattacaagctgcttgaatataaaaggttaatccagtgaagttgcttttgatggaaaaatagtttaaatttgttttcatgtcttaagttgtgagagaatttaaactgaattacgtttttgtaattgttttaatatattaaataaatcaatttgactaatttattccaaggtcaattactaaggagatgttacattgatgaatttattaaatttaaacggatttcatattcatttgagtcaaaatgagctaatgatgtgtcagatattctttaattgccggtacactaacgcttattattttattaatgcaacacgaaataaacacaaaattttatcaaaatccaacaaaaaagttagtaggcaaagtattgcagtcgatcctcctgtttgattctctgtcttgtagatcatacttctccaagtattgtatcggccaaacttttttgtattttaaacttaattatgtattgccgaggtggaagtgatgctaataagtaatagaaaataataaccaacagcatctctgtatgaaaagtgaaaataaggagggggtgaagttgttacgttttagaatgtttccacatataaaatcggaagagtctaggataattcatcatacgagtgcatgattttatgtttcaatttttgttttcttcctgattttaattattatctgttaaaaaccttcattcaacacagtatcagttactatatagtgtatatgcataaaaaaagttacaatatagtgtatatgcataaaaaagttactatatagtgtatgccaaagtgttgaaggaaaaaggttgatcgaactggttttattctattataagattgggtttccgccactttaatttatacataatgactattacgtacgttgctttgtttgaagatgagtattacccaataaaggttgcttatgaaagcattatggtttttgagatcgtcaagcttttccattatttttatcccaattaagcatgagtttgtgggtacgtgtagttaatagttatgctgaaggaacttagaggaaaccaattagtaacttgcagtagaattctcgttaaagggtttaaaggatttagcgaaaaactgaggtaatttaaccaaataatttttgtttcttaactaaatcagaaaatgactatatcaaactagatcgaatgctcttacgtacattcttaaaccatggaaggtacacataaaatatatgaaggatataatcgctgccatttagtttaattaaacaatagattcctccgtctccttcatgttaaaatatacaaagaaagaagtatcgatttcacaatgttgacgttcgtttcattccaacttggtcaaattgatagtccctcactcatcgcttctttgcttctttttcagcctgcacatatgaaagttaacaaaaaattgttaaaaacacagatatatagatgagctttacgatgaagcaattcatagttgttttgtatcataccgctctgactactctatcaaaggcatcagggccatatctatcgttatagcgttcaactgctttccttgcatcgaaggtcatcatgtgaaggaccttcttgtactcctcagaataattggaacttccaatattctttatgtattgcctcacgtaattctcatatatgtaagccgctccattgaacattggaagtaccaaccagacgcaaaacataagcttcaggtatccccaaatgggaaacctgtatatatttttatgccaaagttcaaatattaaattactattatgtgcctctatatatatagtttgatttgacttgaaattgatgtcaacgtaccaagcaaggatcttatgagtggaaagctcaaagagggtcatgaaggagtataaaacccaatacgttagccactgttgatcatccaaggttgaaggactttcaattgctctcattgatgcgtatctatgatatttactcagaagtagtcaagaatttgatgattagtcatatcatgaaataattaatacagataagataatgtgcatgcatgcctctgcgtaggatgcttaattaatttctttttattgattgttaattaagaattacagcagttaatccggaggaagagaaaataatgatacacgattgcatgataatatgatatggcatttactatacttacagaggataaagaagcatcactccaggcctggcatgcagaaaacaaaaaaaaaaggctgttaattattacggggaaaaccataaaatgaaaaacctatagttacagttgtgtgttaaattgcagaatacatattatggtgaatatttttttattaaatgagcattgtacatgggatttagcaggtattgtgtgaaaagtatatattctgtaaggcgcagatataatatagcaatgcatgtgtaggagtggaatgaaataaaatatatatacgacacaaattacagatatttttaaaagcaaattaatggagagagattaatttgttcaccctattattgtgtccaaatgtcttgccattgttccaaggacacccatgatgtagaaactgcgatattcagatatttcctggtggggaaattcaagttttaagaagatttgaaggaatatgggtggtattgttgatgcatgcaaatatgtatatatttagtgtagtagcaggtgaatgaaggaaaggaaaggaatgtttgttgaatgacccaaaagtcttctttttctctcaagagaggaaagagaccataaagattaaggtatactatatgtgtaacaaaacgggaggggaatataaggatgccaaaactttgggatttcatgtgcctttggtgcatattcgagagttatcgtattaccttttgagctctaagcttttgtcattgtggcattaaatgttaccaaggtgcctaccctttcaattgtttttcccagtctcggtagagttgcgtaaaaagttctactactacggccttaagcctttagtatataggacaaaatagtacccatcaaattcaatttaattgaaaccctacattaatagtattagggtcccgagagaatctactttttctctcttcttcttaattttctgaaatatgtgtctatgtatacatgattttaatttcctctttagtgtaatatcagtataaaaaagttttgtgcttgtacttaatgttgtcctgtcacattatttaatacaatttgctatctcttcggtttattaatatagtacgtcaaatgttaaaataagatttcaagcaaacaaataaaatgttaaaataagattgaacgatatcaagaaagtgctttgagtcactagatcttgttagtgaaaaggagtttgaataatttgtagaaggtgacaaattcaaatttcattattatcattatacgaaaattatcttttattaaaaaatatatacaactatctaatgggaaagtgagaaatgagaggtaacatgttgaccataaatatatagtaggtggttaggattatttgacttaaatttaatcttgataatccattttaataatggtcagaattaaattctttcacggtatcatgattttttattttatttttttggtatggtttccagcttattgcattcaatacctctttttgaatgctaatttcattattataaattgatcttattaaacacgtcaagtttataaaaaaaattgcacaatttaaaaatgaactaatacttaatcaaaaaatttcatttaaactataatattttttttaaatataaataaatactataatattgtatatatatgaatttttaataattgaatttatcaaattcataacaaaaaaattgtgtaatagagcaagggtattggacttttgtcataaatgatcccaacaacttgtatctatgtaaaacattttctatatagataagaaaaaaagggagaaaaaaagttaaagtgtattgaaatttcatgtttgaataaagttaatacgttattagtaatttttatccactcacggttccattaaaaaaacaaagattaggcactgatcatttgatcatcggattgactctaattttacaaaattaacttcgtatagaatcaggcaagacgatttaatatcactaaaaggaaaataacacacctatacatctatgaaaaaaattttctcaaatgcaatcatgaacataatattgtatcccatttgcttgctacttgctacttgttatttcaagggtaaaaattccaatacatctgtttttctcttttccctaaagtgatgacatgaattgtacactcccgtttttctcttttgcctaatagagcccgatcaatacaagttacagttagtacattttacacacacacaaattccaaaagattcaatcagaaaaaagtgaagcggtgattccaaaattaagaaaatctaagctgattcaagcaatatggccagccaaagtaattaagaatcttgacatgcttcttctgcccaaaaactctagtcccgatgggttggccttgcttgtccacaagcaccacagcattgtcatcaaacttgacctcactttcatcacaccttccccttttgcatgcatggccgcacgcacaaccacaccatacactaccttttctttcttcacttttccattcggatgtgcctccttcactgatgttattatggtgtcacctaaccttgccctcttcttccctttcaattcttgaatgcacatcgctcatgagttatcaaccaccttcagaaccgttcccatctgtatgaacttgcgttgctgttgctgctaaagcaaaacaatttttttcattagtcagtcagtcattaatccatgtctggcatctttgcattacaaggttgtctacaacgtcaaatgactaagtttagcaaaggtaagaaaaataaataacatgtcattgaaaataggacaaaacttacatatatagttccttagatattgttcgcgatgcactgttctcccattagaattggagttttatcttgataatccgtgtaatcctttaatgcaaaacttactactagtagattacggaagtgaaactgattctaattgaatgacagcataaaaaagtaaaacacctaaaaaacttgacaagtattgtccttaaaatatcactcatgatcacaattttcacaactatgatattgccataattcataaactgacctgagataagaaattgctggatgctatctcatgcgatgttaataaaccatagaagttgttattccttaatccaccaagcaaagaacggtccactagtttggttttcagcacatgaatgaaaccaaagcaagttaattactacttcaccatgcaaaaatcacctcatcaacatggaatataggagtaaattttttagagttataataattattagattttaagaaactaaatgattagaataaaaaataattcttttaaaattatttttataataacttgatatctcctttttccttccccactctctctatatataagtggattccctcccaccatatatatcatgtcaataaaaatgttaggggatctatccatgacataatgaatgcaatgcatactttggcctaccgatttacacaaagcttaattaatatgtgaaatttcacaacttcagattgactattataaagcgcaattttttcatcagaaaaaaaagagagctcaatagctatatactgaaggcttttatgaaaaacaaggagcaaacacaggggatgaagcagaataaaaaagtaaggacttacgaagagtgcatcttgaagtaagggttgcagcatggttgaaaacctgctcattattgggcctccattttttggtttcagagcataatattattgggccacttaaatctagcccatactcttataaacaatgcaaaagaagccctttagccaacacatttaattcacatcaattttactcactctactccttatcataagagatactttaagaaaaaatgaatgatactttttataagagattttagaatttttataaaatatttaatttttctttcattggttgatcttatcaaatattctaattatgagtcttgttaattagtgttcttgtaacattgattaataaattaaaatgagtaagtatttattacgtaaaacataggatatcattttattttattttagttttttaaccaatattccaaagacatatgtttaatatttgtcttttaagtatttatgttttttattgatagtgatttataatactctagcattttaatcttttcacatcacccataacaagttaatgattgttaataaggacataattgacacattagtagtattttttttatataaattcaatagaatcaattgaattaattaattttattggtttgtataattgatgtccaaaatgttttatagtaacaaggaccagatggagtattgtttaaatatttaaatatcaaacaagtattatgaagataaaagaagtttatttccgtttcttgaaattatttgataaacatataaatttaatagtaaattatactggtatatttttaataaatcatttttgttgtgtgtatccatagaacattagaaatagagcaaaatttgtcaatacaaatttgttcgttgtatgtagtttgatttgtagattattatggatctttccgtgttgacagtcaaacatatcctattaaggttgattaattgattttttttttaaagatcacgaaaatatctttggtcgtgaccaatgacgataagctacacaaagaaaaaatgagggattggatagaaaaagttatttattttcctttccttttatgatcccaaccaacaaaaagaaagaagaatgagggttgcaatgttgcaagtatacccccaactaattccatggtcaatcaattcaaagcaaatgcaaaaggataatatttaaatgacgttaacaagttgtttcgtctcgcacgtacacggtacacatttttttgtttcctacaaaatcattccacccatgccagagtgttgatttctttgtaatgagattttcaacaattaattaattctcctgcttcaactccttacgttgtatttttgagtcgtggtccctcacctaatcaatcatcaattggctactagtgttttaggaattttgacttgtgcttcacaaatcatagctgttaactatgatcacaatattgctgttgtggtgtggtccatacatcatgtattcattggcatgactatgaattaccggagtagacgatgtagggcaattggaagacaacaaattcgggtaaagcatttttttttctgacttacttttactagccattcttaacatattatcctatttttctttgtcaactttgttttctccattgggctttcagacgcatatgtgcctcttctgttcgggatacaattttattgttgtgccccgtttccattttactaactttcatcgatagttccaaagtttttccctactatatatcctctcttagaaccttcagtgatatggttctctcagttctattacttctattattatcattataggattttactgttcttatatttgaatagtaagtagtccactagttacatgttttacttgtatttgttattataatatttttaattgtggatttctcggcggcagcttagacaccataacattccattggttataaccttccgtgtgtagttctttccgaaacttcgataatttgttttgattgctttgaggatcaatgattgtccctataaatcaacacaaaatttttctgcacgctttgtcctcactacaacgttttccgaaaaacttcttaaaatgtcatttcttttataactatttcaagtcaaacacatttaactgtgaaattcttaagtgacaaactactaaaaaataaatatatcttgttggaatagacaatatcaattaatttctttaagtcatcatcagctgtataatctcatatgcacaacatttggatctatctcattttgatgtgattcgataagagtgttacaattttagtccttttagtcgattctaacttatttgtaatccacttagaagtagcctgctcaattatcattgtcctgctgcaactatatatgcatgatgaaatttgtaaaagaagttcaagttttttggtgtactcaaatagtcaaataaaagcaacaacctcatttctggcaaaacttgtataattgtattgaggcagcatatctagcatgttcaatcctcaattgtcttaaatttaaaaatccacaatcatcattaagattgaatctactccgtaagcgctgactttaaaaaaaattgtgtgataaaatttaccgatgatgatcaaattattcctctgtggctctgtccattaacttcttatttggtgagcagtttgttgaatgtattattcaacgtacaagaagtaactagttttttggccagaaaattgtcaaaggcatttgagtcaactacattccccattcacattgaagcaagattttggtatacatccaatacaatgtatggatggttactgaaataatgtgaggctttgcaaggaaataactagcatctctaggaatcagtgttcaacgcaagtaaaccattttcagcacatgaaagattctcagcaatcatagttgaagtgtagaaatgacgtgtatgtgtttcaattcttgttcttgtcctacattcttcactctgtcccacctcaaaaaaatccttgatcctgatcttttttctttttctaatgcgagtataaagaattggttttcatgtcgtcatcaatccataaaagataatacttggtcggaaaaatatccatggagacttgagtcataattgacacctaaaaagaaaattagagaacagagagaaaggcgtaaatactattgttgtttatgtttagacacccactatattcaagcgtctctcatttttgtcacatcttatcactaattatttatctttcttcttttcctaggttatcactaattcagtcgtaagggataccaaatgttaatttactttatcaaacattattacttgctcgtagctaacatgagaaaatacttggggtaatttttcacgttaaaaactactgcgtgcatggtcttaccttctaactaatttaatcaccaagtgtttatgctttcatagaccttctgatttatattagcaagtattggaaattatttttctctgggaaatacctgttaattgtcgtagttgtaagtgttgaatggtcatataaatgcataacaactaactttaattagctctcatgtgatcgatcagaagttgtcaagaaaaagatgattgtatgcccaaatttcagacaccatgattatgagtaggtatgaaggaataattgcacttatcaatgggttattatcaaaaccctttccatgttagaacaacgtggtccttaaagaagaaacttcaaggattcaaatttccttttatgatgttaggtcacgtacgtaggaggctaggacatagaatgtagccttaatattggcattaaattgttcagaacagatggcatatgcatggggaaatttgaatttgtaaggttcaacaaaacaatggtatagaattaaatatatgttgctagagaatgaaatctaaataatggctagggaccattcacactgcagctaactaaatcgatgaatatgcatgcctatgaaattattagatggcactagttactggcaagctataggcgttcccgcaatacaatattagtttacattgtacctaaaagaaactcattattgcattaccaaaacttctactcgagtgtttcgttcacactattgtgatttgagttcgatcatcagatttttattagtaagcgatgtgtatggttgtagtttaacaggtctttttttttttttgtgaaataaaaggaattgtagtttaacaggtcttaagacatgtacagttttctttatggttgcatggttctgtttggaaggtaccactggtacccttttagtataataataaatttttcctttggctgataaaaaaaaggatgtgtaaattttagtataaattctcgctgacattaatatagtctttggcaattaaggagatgcgtttttccttaattaatctaatttttttatgagaaaaaaaagaaggaactcattgcatttgataaaatacatagggcattaggaattgagaaagatttcctttgtctggtccgcatcttcagtggattttacatgagacaaatttgatgatacattttcgatcatcttatactcacgaatcaatggcagcaggcagacagaagaaaagttgggaaatatagataattaattactatgcttattttctttgagcaaattatattgcctactctttctttgagttacttctatagcatactaccaaatgcaagtagcactggtagataacttttatcattcatatctcaacgatgtgcttatttagttatgttattgaaattaatttccatcggctcttttacttttccatggtatttgatatcatatctgaaacagaaattgtttgcaaagagggtcctaatttattcatcagtgaatgaattagatggtgttgcaaaatcgttttcttttttctttgtgaaaggcatttgagtaagactaaccaaagtagttcaaactaatgaagagttttttttcttcttctacttcttttatctgtgcttttaattttcaaactgtccaattcaaaaatggtgagaatatattaattgtatatatatgcattgagtgtagcacaattcacaacataagctaaattgtggagaaggatataaatttaatgcttacataatatattaaggaataatgaattttaagtgcgactaaatgttatatcaaatgattacatttattattgttaataaaaaaatattaattgtatatatgtacatgaaaagatatatatatatatataatgaatgataaatgcgcaattttatttgcgaagtcatattctcgttgaaggatgctaatagcttgtaatatctgcctgcatatgaagatatatattagcttgtaatgaagatgtaatcatttctatacctaatagagttttgggagcaaggatgaacagtatatccatttttttaaaccgccgtaattaaattatttttactttgtaatgaaacattctcaccaggtttggtccttttaataatttattcatatttaaattcttttttatgtacaaaaatttaaacttaataataacttatacaattacccgaacatatatatcatctaaaccactgtcttatctgagagtaaaacatacaaattattatagagcataattatcgtcttacccagtatatttcttctaactagaatatgtgttcacgttatctgtttcatcaacatggttgacgaaccatactactgcattgtagagggctttaattaatagattacacactgttattaaggatggaaataggccaggccgtctatcaggggtctttggcctggcctgtttaaggcctggcctgtttattataaaggctaggcttaggctttttgaaaagcctatttaaataaaaaggccgggctcaagctttaaaaaaagcctattaggcctatcaggctggcctatatatatatatatatatatatatatatatatatatatatatatatatagatagatagatagatattaaaattaaaaagatataaatcaatcttttaaaaaaagaaataaaataagataagataaaatctaaatagtctatcttacttaaaagataaaaaataaaatagaaaatttgaaatctttgtagtaggtttgtataaaagtcaatatatatatatatatatatatatattaaaactaaaaaatataaatcaatctttaaataaaaagaaataaaataagataagatacttaatctcatattagagtgctctaattaattttaatttttttcatgcacaaattaaaagggaagtatgtcaatatgtgtctttctttatattaattttaaaaaaatattatgcgaattctcaaagtttcactaatatataatatttattgtaaaataggctttttaataggctcgtaggccaagccaggcttttaaataggctagatcaggcctaaaaaaaaagcctatgacaggtaaataggctaggccagacttaatgtttttaaataaggtcaaggaatattggaatgcatgcatattttctttttttatacacacaagaataattaagagatgccttagcatctcatactgataaagaataactgtgtatattaagattaactgtgtataaaagacacaaccaaacaaccaacattattaatagattaaatatcacttttggttcttaatttatcttttttttattcaatttgattttcttcatcttttaaaatattcattttaatcttttatattttaaatttattcattctaacccttttttcaatgtagatttaacattgttaataattttaagatattgagtattaaaaatcgtcataaaacaaatttttcttcttctaaaatatctccataacctaataacacataatgattgcttttaattcacgcactctattttatttctattattgtgtattgaattatgctgtcttatagaacaattaacaacttatatatttttattttagtttatagtgattaaaaaaatatgttattaatttgtttgtaaaagttaatttactttgaataattttattttttaattatattttagaagagttagaacttgtttgggtatgttcttttagtaacacttataagataagaaaataagaagaaaaaaataaaataatttctctataagttaaaataaattttctattggataatcattaattaatttataaatgtcctttcatcttttagaaaaatatattaaaaaccttttataaattgactaataaaaatcttattttagctaataaaaaagtttatctcattaattttttatttcttttctttttcttaaaagtatttctaaaaaaacttattcaaataagcctttagtgatcaattcatttagactactcctcaaggattggattgaacttacaaaattttagctcaatattaatttgacctgccctagctaaaccatttttttttggcatgctccttgattgaccaatacaaatagatcggactatctcaaattgatagctctataaatttcatcaaatatgtcaaatgcacgactattttaagtgagtgaagatttcataagtgaaaaacgaattacttaagtgcatatgaagatatatattagatatagatctaataaacgactaatagatctaataaacgactaaggtttttatttcagatgtagtgtgaaatattggttctatcataaatgatatataaaactctcactcatgtttatatatactacgtatcaagagaaatatcacgtcaacttgagtctgttacgcagaagttataatttctaactttcggtcgacacacgtaaattttgattaaatgcggaaacacacagttaaaagaagaaacaaaaaaggagtttaaacacaggaaaagatttcaatatgcttcaattctagtgtgaaaatttgtagctcattgacgtaaaggttatgctcgggatttaggcccaacatctattacttgaaggtttgactaattaattggttcagaacttaggttagtctctttatgtatcataggtacgatttttttgatgaaatcatcacatgtacgattaatcagtcataagtttgattctaattatgtaatctgaagaaaaaaaataattattattattttaaataaattcgattaactattacacatgcacaccttataaactgcattcatatatttgaaaacaagggcttaaacgggccactaaaacttgaagataaccgtgttatgaaattagcattttctgtaattaacttcaacgtttattttttagtaatatcttttttttctccataaaagcttatattatttaaattttcttaattaattttaaacacaatagttagtttttttttgtacttcaatataatacaatagttagttaattacatcaacctaacatgtgtttatattatagtaaaaaataaattgtaatttttaattgttcctttaactagatcctgcttaaaaggagatctaattcaagcacattcaagtattaagtgtaattgtttttttaggttaatcgttcaagtttatatagaattgcatcagaactaatcaatcagataattttgcaagagtatagtgtgtgattctatctgttgttccgagatcctcgagtgattaaagttgcttaacaactaagcattgcaaaaagtagaatgctgaactcgtaatcaggaattccttggtcgatacatgagggcatggaacaaagggagctccaactgagcctaatgacgaaatccgactgaagggacttgagaagtgcactaataaataagaatctttaattgaaagattagtctcgtatcatgcaagtagacactcaaacaacaaaaacaaatacaatggtttaacttcatagatatatattttgttcctgatgatgagtctatatatgtacccaccataactccacaagggtcatgtgaggtcacaccgctgtgtcctaacacattgtaacaccaaattcaaaaggtttaatgaagataatttaaatattaaccaagtcatttaaatcaacaaggtactggaaagtcatgagaagaaagaaaaattgcaactgagaatacaagtctgattttcccattacccaaaatacaagatatatattgaagcctatgcaaatacgtcaacataaaacctggtcaaattctgcaataaaaaaataatgaatcatactaacactccatggaaatggaatttaatgatattacactaagtatttgtcttttttttaatcatgacttaattcatataatatcgtaaattaagaaacattgtattaacaaaaatacacaatattacgttgctatctaaatggaaagaaatatgtataaaatcaacaaaaagacctatgaaatataatattaataaacctagttcaaatacttaagatgtaaatatagtgcgcaatatttcacatatatttgataaattattttttagtctaaaattaattttaaattaaagtaattttagataaattttgtctctgatgaaaaattatataaaacttactattaacttattgttaaacattcaaacataaatgagtttacttaaaaaaataattttaattaaaattaatttaatttaaaatcaatttacatgcttattcaaatattatatgtgtgtttagatgagatttagtaaaattaattttaaaatgatataatttatatttgtatgtttttttattctaaatggacattagtagtaaaactttataaattttttcattcaatacaaaaattacttagtgtatatagataagtatcattaaaattgattttgaagttatatgttttatgtttggatgttatttttttttatcaattctaaaactcaaaattctttaatgtgaaaacataaaaatttatttaactaaaaatgatatttcaacattatagagaatctaatctgacaccatgccacacacttaaagttttctcaattcaatcaattccagatgcaaaattgattttttaacataaaacaaacatatgaatattacttaaaattttgttacctgatatttcaaggtgattctaaatcatttaacttgaatccaaacttaatttgtcttaaattcaaaaaatgcaagagttgggttgagtgagcaattgaaaactcaggtttcaagcatgagagaaagagaaacggggctgaagtggagggaaacaaatctagattagattctagcaggataaaatgccaaaactcaaaatccaagaagcaaccctgcagctatgcttcaaaaattcaagctttccaagtttttgcgtgcaaacttacgttcacgtccctctccttggaattgaatgaaaccccactcattaacaaagtcactttcaaaaagacactttcattgtcccccctcacctttttcccatacatgaagaaaaatgaacggttaatacattgagcatgaaagttgacaggtgaaatcccaaaccccttctcactataccctttttcttttattttccaaacattacacaaggagttactaccaaattattattttcagtactgagagttggagggtctattttctgtccataaatacctgtctcataggccaccccacttccatattttgcaacattttctcctcacatgttacataacaccaaagaactacaaatagttctcattgcataggtacaacctaattagctagctagatacacacccttgtttctttccattctgtctttgattgattattatcttcatatcaaggacaagcttaatagcttatagtttaatgacctttttattccaaagcttcttctttggttctcctaattaagttcatgcatccttaatggagtgatactccaaattaaataccaactttcggtgttttactttttttttttttttgctaattaaattttttaactagatagctctggttgcagccatagatggagtttcccaacgaagcaatatcagaagggtgttcacagaagaaaacgggaagagggaaaatagaaatcaagcggatcgagaacacaacgaataggcaagttaccttctgcaaacgccgtaacgggttgctcaagaaggcttatgaattgtctgttctgtgtgatgctgaggttgctcttgttgtcttctcaagccgtggacgcctctatgagtatgccaacaacaggttcaaatattcttttactactgattcaacacagtacttttcctctccttcaatctcatttcatatcttatgaaccatttaaataacacaaaccatatctagaaacaaaaagggttttatatatggggttaagaccttttttcttattatgattatttttgtttgttatgtggtatcatatataactgaaaggcatagttagtagataatcatatgtcgttaaaagtttaattttttaatttatatgtatgaaaaaatgtctattaaaagatgctaattatttaaacaagcattaatactttgaaaaattagtttttttaacttctgaccgatgaatactctaggttcaccatgtatatatcattctttctaactgttgtacttaattgttgctctatcacgcgtcttcccagtgatttttaagaagggtgcagatctgtgtaagcgatagaaattatagacgttaaggtgaaacaatatgaagtatgtagcagatgaagagaaagctttagttagggttacaaagatttgcaggtgagaaatcttagcttcctggtgtatctgctattgttaagctttaccaatccctctctcttgagtttctctctccacttgtcatccatcaaatcttaaaagggtctgggttgctgcacaaagctgtcatgcactcaatgagccccttccatcttgactcctccttaataccacttatttgtcaatgtatagtgacacaacacaagcatctcatccaattgggagttagggtttcagacttttcactatttagtatttagtcacacctcaatcacttcaattcgtttttacatatgtacacaaagttggaggaagaccatttcaattctaatgtgatagatcacggggaaatgcgcagaaactgcaaactaattaaataaccctttcagacttttattcacatagtaaacttgtatattttttttataacatcttttttatatatatctttttattgtataatatttttattacatacaaaaatttaatttgtactaatatagtttctctttttaagaatatttttatctccgtacaatgaggttacacgaagaagcaatcaaatcagatattagggctcttgattcaaaatgggtacagttttctttaaagttgcaacagaattttcacaggattaattgtttatgattaattaaggtcatttttagtctataatgcttcaatattttttaaaattcttactaaagtattcgttataaactctttttgagcataaagtaaatcaatttaaactaataagtatatcgagggttatggatgtcccaatttgtttcccattttcgtaaattttgtcctttacataatggaggaaagtctaatatggttagggcgtttcccagcccatagggtattatttggtgattttactttaaataacttgaatttcttttgggtacgtaaaacaaaaaacaaaaaacaaatgaattaagatgaaaaggcaaacgtgtaagaatttgattttgtgcataaaactagaaaattatgaagtgtagagaaacaacttttaggagaaataaatatttttagaagtgtagagaaacaatttttatgagaaactacaacctcattttctcatcctcatctcctatatttttaagaaaatatatcatagtgtttagatattattattcccgcttctgatttctttaccctaagtagctaaaagtaacatgatgatagcagattctaagaatggctaaaggcaaattaattctctttcccatatgtttttattgctttcatctttgtggaataaagcttcccattcctgacgtcaattctttacctattctctccattatatatgtgttttggacatttcaattaaagagaaagttaaacttacaccggcccactgatgcaacatcgacctcttcctgcatactcagtaaataaccactttgtatttgaactttagagaagttcagacagatggggtttaccattctttaagatcaaaagaatgaaacttcgtgtatttaaccatactcaatcaactagcttgttaatttttgtgttcttaatagaaaaaatttggatagggcctaacactgtaaggtaaacaaagaaattaaagcaagaggtcactgagctatttatatgaaagagaaatattaataacatttttttaatattaattataattatgggtaagattcaccagataagaagatgcacagaattttataatttataataattttcaatcaataacaaagaatgtgttagataatttgttcctagcatttctcttgcatgtaatagatgtaatgtaatttgtcaatttcatagattccaatggacattgaaattaaaaattataaggcttaaatatgtttttagttcctataaaattagcatgttatttggttcttataattttttttctttgctttccatccctttaaaatttaaaattattgatttttcccctttaaatatgaataaatcttaattttggtccctataaaacatatatttttttttattttaatctctagaaatcctttttaagatattacatgttaacattgtaccatatatatagacactagctgttgttacctgggacggtcacttgacattccgctgaacacataagctattaacgaatgtcacacaataatagagataaaaaataaaattttaaatttttgcaggatgaaaattaaaaataaaattataaggacaaaaatcaaaattactaattttatagaaattaaaaacatattttgctaaattataaatatacacccatttttattacaatctcaaagctttttggcctaagaatttaatgtcaaagaagatgagttcataattaatttgtaaactacagattaagtcgacaccgtgtacgtgttttggtaaaattagcatgtactttatcacatttttatgtttctatttgttgtattgttttgcagtgttagaggaactatcgataggtacaagaaagcatgtgctgcttccacaaatgcagaatctgtctctgaagctaatacacaggtaaatttagtaagctaaaaaaaaaaaatcaaagaaatgatagaaaatgctcttgtttggttaatttggtccagaataaatgttgttttaaaattacggcatatttttcttaatagaattacagcgtacgtgaaggttaattatttcaagctgcaatcttctcaaagccactaaaatcctttatcattaggatactctaatagtctaatgcttagttttgaatgtgacatttacgagttcaaatgttcaagggacatcttcaccaatatttgacagtttggtattgagaggtatgatgagtcccacacgagacaatgttaaaatggatcaaaccaattcaatccaatttaatctgcgctctcaactcataaaattaaaaatggattggacaaattttaagaatgggatgaaaatcacaatcgatccagcccaatcttagtgcattatgggttggattgaattagccataattgtttttaaatatataaatattatatatataatatttaactcagacttatccaataaataaaacaaataaatactttaaaaaaatctaaatatattgtcattatcataataatactatcttactaaatagtcttagtataaatgttgtttaaaatttatcatcatgaaaaaatataaagtaaagcaacaaaataaataatagttcaataaaatcaacacttattggtataattatgtttcttaactaaatgattcataatatttttagatatgaaataaattatattagaaagaaaaaaatatccacttaatttatatatattcataattcttgaaaaattaatatcatactaatatcattagaaaaaaaataataaaattatgtccaataaaattccaacaaaataattcacaaaagaatccaccttttgacccattgagttaacaagttatgtaaatttaacatttaattgcataatgcaactcaacctattttcatgagtttaggatgatttgtcgaaatttaacctattttttacaatatatacaggttgaaacagttagaaatcagttatctattagctcaacaagataacagttaaattagttagttgctccttcagttatatatatatatatatatatatatatatatatatatataattatgttacttttctctctcatgatatatcaataatacacattattttgttaatatctctcgtgttcatgttctctcttcacttgagctctatagactgtatcatgcatgtttctcaacacataattcaaatcatcacactgaaaaatgaattatttgttttatatataccttattctgcgttctagttaaattttaattctcctatcactaaattaattgctatatcataatgctcctccacaaggtttctctaactggttgacactatttatcaataccagttttatcagcaggaagcgtccaaattaaaaagacaaatcagagacattcagaatctaaacaggtcaatgttccattctcttaaaaatattattcatcagacttctccattgaaatgaaaaaattcaatgtgattttttgcattccaggcacatccttggtgaagctcttagctctctgagtctaaaggaattaaagaacctggaaagtagactggagaaaggtttaagcagagttagatccagaaaggtattatattatcagcacgaagcatcttaagcttctaaatatataggcattgtgaatttatgtagatatgcaagaagttagtcaaaaactagcaactaattaagataatttcagttagtattttgaaaattccaagttagaatgtctctattcctttggactaactacgcactccaattctttcagcatgaaactttgtttgccgatatcgagttcatgcaaaagcgggtactcatcatttccttcgatgctattagtttctgcttaatttatttgcttcatacatatatatatatatatatatatatatatgtatgtatgtatgtatatgcatatatatagtatctaaagaaaatatatcaaagttttacgatattgaaaccaaatgcatattttcaattaataggaccaagaatatgaaactgaaacgggataaacccagaagaaattccaatattcgtgaaaaataaagtaaaaatggcttgattgcttcgtacgaagggaattataaaaccttgcaaatttatgcctgatatttatattttttctaacatgaacattatacttgctgaaaaaatgcaggaaatagagctgcaaaaccataataattttctgagagctaaggtgatcatctcttaattccctccaagactctatatataaagtgtatgtcgagatgaatgataattaataatatatagttggtggatgatgcatgcatgtagatagctgaacacgagagatcacaacaacggcaacaggatatgataccgggaaatgtgtgcgagtcaaccataccttcacaatcatatgaccgcaatttcttccctgttaatctcatagattccaataatcaatattcacgtcaagaccaaactgctcttcaacttgtgtaagtacactcatcttccactgttaattacaagttgttgttattgaatgcccttttaataattattaattgatgaaaactaaaacaagctcgagggccaatgaccaatgaaacaaacaacttaattgctttcaacattgtaccaatcctttatatgcatgcaaccgtatatgcattacataagatttttaaatggctactaacaacatgggttttaatgtgggaaagtggttagtggacgttcaacttaaatggctcaggctgtgtttgtattgccctttagcagtttgaacgccaaagctttctctcagtaaaattgtggttcaacgtgcattggaacataagaaatagttcgacttacatatatatcattttacttgtttttaagtcatcaatgtaggatttgttattcagcatctccccaatccaaatggcatagccaagctataacttgttttcaatagtcaaccagggtaaatttcacatttgatcgagattcaaagatcatagctcctactcaagtctttttttgaaatcccttttcctttttttgtatatgaccttgttttcttttctgggcaggtgggtttttttaattttctttcttaatactgtttctctcttttggatttagtcttttcttgtatatgaaattttttaatagaaaaaagatgagtggacaccaatatggtaatatctatagttaaatataaagagaaaaagtttttttttaagcaatataaagagaaaaagttagagacaagtataaataataaataatatgacttggtagaaagagatgtattaaccttttatgccgtgttttttatatacaaatccataagttcatgattttgacagatgattccccatggcaaaaccattttgatatgtttctcacttccttaaattctcacctttggatgcagctgataagtgatttgaaattatgccacagcctttcaagtggtgtgggagcccttacatcgtcctatgtttcgtgaatgaaagtgcccttagaaattcctttgctaaagttcttacaacggagaacaagacaaaagctaatcagcacttgtaccaatacatcatatgatattgtttatgtatctttcaatatatatagtttctattcagtcctggcatattgtatttttatgttataaatgcttatttcaatatgaacactatacctatcgaggagtaaaagttaattgggcctccgcattattcatcatatataatttctccattatattccccccaattatataattctgaatatacgaaaagcctgaataattgcatttttttttcatatgccgtgatcactctccgctagttggggaaaaaatccttgttttgaagaagtcaggcttaaaacttcaaagttggacaacaaagaggaggattaagctagatcagtgggttgcttctgattctcaagcatatgaggaataacacaactattgtatttgattgtgttgcaagtcttacgttgagtaaaataaaaataaaaaatcaaagtgaataagttagaaatgtttgagtttattaagtttagacttttaggagaacatgatacctaaacttaaaacattaacgagcctaaccacattctattattaggcccgcaatccataataaattgttcggatagatttccttataaacacttctagaaatgaaaataagaaagtaaacttaaacgaacttcaattcaccctaggtgaaaattagtaagttcttttttttttaacttctttaaaaaattaattttaacttatatgtaacctttgtcaaaacattatatataagttaattttttaatttgtgtataatgtttatttcatttttacttattattttttctcttataattaccagaaaaattatccaaataggtacgtgttttaggtataagctcttcggctgcatgatttcaacataacttaagaatatacccattcacgtgagagaaaaaatcacatagtagacctgtccattccctccagcttacatacagaaattgcattaagtagtaatccctgttgtcctaaatctttaagcagttttacttccaaaatcctcggtttcttgcagtatatatagtgaccaaactcggcaacatttgttaccggggtctgttccttgttgtccaggttggagtcacagtgaaattgtaccaatcaattgtgcaggttcctttgcctcctttttgaaaggtttgtagcctcaaagtttatataagattaatgttatcatatatcaaattttgacaaaaaatttatacaagaaagagagatagaaaaacaataaatgttataagataaatggtactataatataaataaactgttagggacaaagtcccacatggtgagctttgcttttagcttgcactccaaagccataaaagaaggcttggtggaccctttgttcacatcccaaaatcatttctcttcttcctttatttatatagtctacttagagaagaaaaatatgaaaaaaaatagtttctccgttcttttagtagtagtattttcctctttggtagtgtcaatgtgcttttcttgtgttcggagagagaaatgttgtactttctttcacttaattagtaaaattcttttcactcattatgatgtcatactcttttctcatctcttattttaattgaattataattttgttacttgtcacccatcataaccaaaaaagtgaatgggtaaaaattattttaaaagtttggtgttgaagtgttttttctaggaagtcttatttcaaaaacataattataaagattcacacgtcaaattctgttagggccttttgactcaaaatctcctcccgcatttaacttttagtacaattactttatataattgatgttaaaagaattatttttatttagaaataaattttcaaaagttaatttagaaaatttagtcttaaaaaaatcatttataagataaaattgtaaatatatgtctaaaattatgtggtatatacatctaaaattaacttttattacctagaaagctaaaaaaaattactaattccaaaagcaattttattttttaagacggtcaccattaaaacattattactagatacatattacaaatataaaataaattaaatattgatcagtgtcttctacgggcatattaatttttgtttttattttatagttcctcttattaaatacgttggaatttatattgctattatttttatttaaatttcaattaaatataaaaaatatatagtgctagtgttcatgaaaataattggatccatttatatagatgcagttaaagtaaaggaaggattaattctcgttcatattaattattcaacaggtataattaatttaaagagaaatataattagggttgatttgagaataaaataactaaaacttaaattttgattgataaaacaaaatatacttttaatttttataaaagaaaaaaagtcacgcatatatatatataaaggctccaacattatagctctcacgtataaagtgaacaaaattctctcaaattttactttagccacacttgtaaattgttggggaccgaccctaattaagtatactaatgtaaaatactcttttataaaatcggttactattagaattaatccttcttaaaaacacctgctttctatatcaattgattttgcatctatatacctagaatcaatctagaaaattaaaaataatcatactgaaaagggttaataatatgtaaggagatttgttaacccttaatttaactgtaacattcaatgcaagtaaggatctaaaatccaaaattaacaagatacaaatgctgttcaagtgaaacaatatctccattttgaaaaacaaaataatttactagactactggattatgatgcttatatcttcatactcttaaactgtagagctactgctagcttcttctaacagggtacgtattgtatacttgcttcatctatttgctatatatttatatatggacatgcagggagcattaccgtaagtcagagactgaaggcaagacattctttcctcttatcccatacggtatcattctatctccatattggaggtggaataactttgtctcttcacactataatcctacatttgctaataaacttatcggagaaatttacatatctagtccataaaattcgaacctcaggtaagccaatttcaagccacggctttgctgggccgttgaaatgaacaatagcagcagcttccacactctctatgctattgctaatttcttctgatcgatggcgataacccaaatcagtgacgaaccatgatgaatctatggggtgcacttgacccgcaaaagcaatcaaggcaggtggaagcactccaggattccataatgtcaacccggactggacgttctatgtcaaatttcaaatcatacaagtatacatgcagttaattagtatgatcatcagaattcacaagacagaagaaaacagcaccctccatgataaagaattgaatatagtgggcaattaatatttctctctctcaattataagatgactaatgatagatgcacacctacataatgtatatacttactaggatcttaaatacaagcaatacaaattctttattttttttatttcaaatataaacaaattttaattatatgtgtcttatttaataagattatctctaaaatatctttcatatttttcatgtttaatattaagtttcaataaaaaataatttttaaaaatatttatttttaattaaaaataacataatttaatgagttaattaatttttttaataaataagaagtatgttttaatcaagaccgaaatatatatatatatatatatatatatatatatatataaagtgataacaatattaatttttttttatcagtcttgtcactgatataccacatgcatcacatatctacacatttttctcttatatctctatttctctttaggtgtctagcagtagcgcattagtgtccatggattatttaactaagacattataatacttgcttgatatttctcatagtccatacaaactaataaaagatttaatgaacatttcaaatcactcgtgttgatgttcattaagaatgatgagacaaccgaattaagaagtaaaaatgtgaagttaaaggattatcttgctagctagtaccattttgaagcatatggaaatttgtcaaaacacattttaaatagaaatgcagttgcctaataacttccttatgttcatcaaaatatacttacaagtttcaaccattgatgataggtcttagtaatatttgatctcctccaagcttcaagatcaaatatattcacgccaaagagccatgcacacttatcaccatcaaagttggatgatatgataggatgtgaaaaattcaaaaagctgacgtatttgtttccagggcagcaactgttctcacaccatgacttgaacactgaaccactgactttgccattaatatctagttcccacaaagaagatatgtcatgttgtactacaacatcatcatccagcaatactaccttgtttagatctggaaacagctgtgatggtccacaaaaaatcagattatgaaacaatcatgaattattactgagcattcgtcttgttaattattactaaaatcttattcaaggttttaaattacagtcctatagtttcgttgagttccttgatattacaggaaaagtggaataattatcaattttggggagtcttatttctaaatcatgaaagggagttattaaatgaaacgttaaactcaaaaaaaaaaaaaaatgtcaataaatttcaggcaattataaagaaaatattagaaaaatagtaacagagactattattagcattgctcccacaggaaattgcgaactaatgcagtcatgattgtaatcgcattgcagttgcaaacaccacaaaaaccttccaactttgaaattgtggttgcctactattttttaaaaccttgatcaatcttagggctagctaaagaataaagaaaaaactaacatgtattacctcagggatatagatgcgaagatgattcaacaaggaaaggctgctgggccttaaagcttgaaaatatctgttatgctcttcactatggtcaagctccttttctttatagttgttgtcgtagtgcttccaaattaactgatttgtttcctgcatctctctaacaccagcgttcacttctttagaccaatcatagtggtgtaaccctctaacttgtacaactgctgagttaatagagttgatggcaaaccaagtatgcattggagtataagttttcttgtcagtaacgacgtgaaaaactagtcttccagggttggctgaattttcaacagtggaggttacaaccacggaagctgcaaggacgttgtcggttaggagaacaatgtggtgaaaggtgggatcaactaggcgagagacatgttcaggagaaggtagacgagatcgtgccatggcatttacggcgtattcttcagccaacttcaaacaaagacaatgcagactttgaggaacaccgtgtgaagctatatgccaattaagtgactccttctttcttgctgattgcacctcacgttccatctgtgacagctacatatatatcaacataaaataaaatgacatgtcagacattatactatatcctaagagtaatcaacaagcaaaagattatattaacaacgtaaataatcagtaaatgttgtgtgtaccatggctttggtcttgaaagcaaatgccttgaggtcttgttttaacgcaaacactttcacaagctcgttaaatgacattgctcctccttcattagcattgccatcatttgcctctattagcactctggtcaactcatctctgagtttcttcatgcacatacatacagtatcaccgtaaaaaacgagaatgaaagtcacggaaacgtaaaaatatgagagaaaaaataaataattttctcatttatatttttcatatatatttctttttcctatatataaaatctagaataaattaaaattttactaaaaacttacaaagctataaataaaaccatttatgtgcttttaccaaagctttttcaatcagctttataagataatattggagtctccatataatatggttaagaatttaatcaatccttactgtcctcattattctaaataaaaactaaatttcagaacttgcaatttgaaataattggttcattgccatgtataaataaaagttcaactttagcgtaatttaaaatagttggttctctgacatgtcaaatggtaattaatctgtaagcttagaatatatagtcaaatatcatttttatcaaaatatctctgaatctttctaacccattttctgaaattttaaataaattattttaacatttgttgtgtccgtaagatattgattacggttttttttattaaataatagattatatgtttaatatgttattgtcacttatcatttgatagtcttttttctaaacttttattttgtcttcttatttttctttttgtcggatccccatatgaatatatgataaaaaaaaaagacaaaataaaaaattatggcttattatttttttctaaacttttattgtatcttattatttttcttttgtcggatccccatatgaacaatatatcgtccgtgctggcagctagtgttcgtatttaaattcattttcattttaaatttataaaattatggcatttaacttaacattattttttacaacacataataaaaaatacagttaaataaataataataagcttgtttattaaaaataatatatatatatatatatattagtgtacttatagttgcgtttattttataaaaataaatcatagaaatttaaaaattatttattccagcattatccagctcaccttaaaacgaattaatgatcatacagtttattaaaaaatgttatccaaaggattacttataagttgtttattcaaatacaaataaacaagtcaaaaataataatagattggttctaccagattgtcgtcacctccgccgaaaaatgtcgatcccacgcaatctgcaacaattacaatggttcatatatagatgctgccataaacttttcaacaaaagatgagctcattttaaggatgatttaagatttaaatttatctttgtataactttgagttaaacaagctaaatatgtaagtttaattttgatgtcctatcagtgtgaagatttttttataccatctactactaaaataataactttagtatgacaaaaaaaattataaaaagatcaaaataaattatttaaaacttaatgtatcaaaatagaattttcaaaaatataaaaattaaaatcaaatttttaattaaaacttaatatatcaaattaagaaaatagatcaaaaattgcatttaatttaataaagtaacatgaagagtgaaactttcattctatcaactcttttaattagacacctttaactgtattttttttctcttttatacggatatgcatttaacatattatcttatcaatgagataaaaaaaaaaaagtcattttcaatcatcttaaactagtgatttgattactgattaagatttaatattgattggtgattagtgatcttaagtgcacatagtattatgagtgcatttgataatattattatttccgctgataaaaaagtacattttatactattctcctattaaaactagacttttacttcactaacatatattaacctttaaacctttaattaaagtcaaattttattacatagattattaagataaagctttaattttattgaagaatcatgttaaaagcatttataaagctacacctgaatattatccttaataaataaaataacctattagtggtataggatttaggagttaattagggaaacattaaaattaaaggtatctttgtataatttataggtattcttcattgaaaataattttattcgacttaaataggattagtatatatccatgactcaaatttaaaataattgattaagttaatccatgtattccattaatagttaaaaaattaaaggtatcacaaaacttaaactagtttttttcaccttttataataataaaatcataatatttgtaaagataaaaagtgcttatttaaatatattatttcaaaatattttaattaattttaaattccactacacttttatcctttcgtttgttttataaatttcacgtttaaactatgcacagaatctgttttatctaattaaattgaaacaactgcatttctctatgaaaaaataaatatcaaaacaaaaagaatgttattgcatgtgtttatatataaaaaataattattaaaagttttaattgcagcaaatacttgttattaaaaaattcatttcaaaatgtttcttaaaaaataccagtattattaaagtaatcgttaagagaattttgaaaaatagtaaataaaaatttccttgagattattatgttggacctaaaagaagccaaatgaagctgaaaatagtaagtttcggtatttattattttcactatgattatatacactgaaattcattcatatgtacttgtcccacactcaactgttttccttaccgaactggctactacaaaaaagttaacagtaaaagaaaaaagaaaaaattacgaaccaaaagtaaaaaaatgaatcggaaaagaaaaattaccaaaggtggagcacaccgcagaagattccagcaccaaaaccgccactctcacaaagctgagcagcaacacgattccgagcaccaccaccatccggttggaaatccggcgagcggggacggtgtaggcaggagcagtggtcttggcggatccttttccggcgacgagtctcttaatccgctttgcagatacatagagcttcatcttctgaattccattccctataagctatatctggctagctttctctccgatcgaatcggcaccggatctgagtgacgaagagagtgtgtgtgttgcattcgtgtttggatcggtttctgcgattgaaatgagggttgagttttttagttacggggaaaagaaagaaagtagtagttgctgaagtgagggagataaagaaagagagtggaaatgcgaaaaccaaagtcgcgggaaatgattaatatagcaattacaccttggtgttgcgatctctcttttcgccactgtttttcacgttatttactcttttgacactctttcgccgacacctccatgacgtgacacccgcttcttcgagatgctgccggtacctatgaggctataaccagtatttttcaatttcattttttttattatttggtcattttattttttcaaaaaagaatatataaattgatagacataatcaacattttattcgtctgttgatatgattttatttttatttttcatttataataagtgaaaatattttaaaattaaaaaaatattaatactgcctccttctttatatattagacactttttttaaaatctatttgtttctttttattatatttttttgagttttcttttgtattaatctttttaattaaaatattcttaaattataataaatattataaattaataagataagttcatctattatcttataaaaattgaagaaaatgattagcacatataaattaattagatgaaaaataattaaaaataaaaataaaaaagtgaggcatatcttgataatttttaaaaaataataaaattttaataaatttaatattactaactaaattaattaaatttaaattcttaatatgtataaattaattaaaagtatcttatatttaaagacaaatggagtatattttaaattttgcaaagaaaagtttttgtttaaaaaataatagcgctaatgataaaaaaatatttgtatttacttaaattaaatttaataatttaaaatttgaatcttattaactaatatcttaaacatattggttaaataagtaataataataataataataataatagcagcatatcatgctaaaaataactcggatatactcctatattaattaacagtatttttaatagcagtaaaaaaatagcatttttagtaaaaacttatacttttaattttttattgatgttctaaaaaaattattaaaaacttttaataatttactatcttttggaaatctaacgtttttaatgactattaacaaagaagtactaccactgtaccactttcactcgttttttgtttttttaagaaattaatgttgaagtcggcgatcctgtctccaacctccacgtgttgttcaattttttacaatgcggatttgggctcttataattgtgtatccatttttaaaatattaatctatacttattgatcatattctaaaactatatattatggaatgatgtgtgcaacccaacgctagatgtactcagaaagcaatcacaagtaaaatatctagctagcctctaggtatatatttgggcttatttattttagagagaaaaataaacaatactattaattattaataaataagattaatagctaatattatgtacatatgcaataaattatgactgttttaaaatattgaaaaaaaaatcatgagatatgcataatttagagaagctagccaaatctatattcagaaaattatatatatatatatataatattcaaaatattaaatagcatattttaaactacttataaattattattattattattaaatttgccggtagtagttgattatcacaagttctacattttgcatgggttttatcaatgatctcctaattaataaattagatttggatggacatatgaaaaggaatctaccacttatatttaattgatgttaagtagtagtagtatttggtacggcatacggccccagtttttaaaacgttgtgtacagccacacatctgaatcaaggttttaaaaatcatagtgggagctgaggcgaaatggtataattaattataattaatattattatttttattttaatataatatattaaataatattaaacaaaaaatcacataatatttataacttcataatattaaaaaataaattaaatttataaaattcatgactcataatatataatattaaaaattaaatatgaaactaaatcaaatatatcataatatttaaatttaataacacataataatatttattagtagtaactacgcttaaaaaataaagataataaacataattatctttcatcataatattgttttagaattatatcaacaattataatatcaagtttttaatttaaaatataaaatataaatagtttttttgggcaaactgattcaaacttggatgattcgtccagttttggattagttcaattggttttttataccagtttttttgtaagactgatttctagagttaaatgaactggtttgattattaatttctggttcaaccagtgcatgccaattggttggtttggttcaattctaatactaatattaatctgaattattaataatttttgcgcgcgtgtgaaatcttaattacttgtagttcgatgccaactgagaaaacataatcctgtttcatcattaaccaaatttacataaacttcaacgactgtatgttagatcttagtctttttttttattttttttttattttttatttttacaacgactgtaggttagatcttagtttctacaccgagatttttccgccaaggaaaaaaaaatggttattattagtatgtgtttacctaaattttgaaaaatgtagagttctaaaaaaatatggcaagtggtagtgattgtatacctaaagaattagataggggtgcaaacaggtaaggatgacacgtaaagaaaaaatatataatgggaaaaaaaacttctagatgattttttttttaataaatactactatatataatttaaatcctctctttctaccaatttaccccgggatttagatcctctcgtaaaacgatatgattacgttggaaagtaaaagacataatagaaagaaaataccactataactagtaggtttaataatttatctgtctcttttgtcattctcctttttaataaaaagaaaagaaaagtagtaattatgtatatcgtgcaatgaacagctatatttgtaaaaatgtaaaagttaaattaaaaatattatataaaattaactcaattgataaataattattttaatgataacggatataaatatacaaatatttaaaaccttgaaacttttaaaatctcaaactattctaattaacaaaaaaatcatttatgatttacaaattaaaattctattataatttacattgatcaaagaaagttttcttcaatgaacgagaagcgtgaattaattacaggtgactattatcagaattcggttggatacaagtaattgtaagttgatgaggaaaatatcataaatctcaaaaagagttaaaaaaggaaatccataagtaattaacttattatagagcgaggaaactaagtagagagagagagagagagagagagagagagagctgcatgtgctctgatacaacaaacagcaagcactcatatgttaagtggagctaataggtctagcaatctataccatgcattgatgcatgttgatgcaatatctttgtcaagttgcttataatatcaatatatcatacgaatgagttttacaattggtacgtaggaaaattaaaaatcaaacacatgcattttaagtatctattagtttggtttcttttttttattcctttttctagagtcttattcattaattattttaattaaacatataattgaatgccttcataaatattcaattctccctttatttcttactcgtgtaccgcccttaaaaattgttataaagccctcgaacgtgatataagactaccaaaattctccctttaaaggactacgacatgattgtctgaccttaatatctcccttattaattcttgatgcagaattggagcaagcacatagatgagttgagtggtaaagaaaaaataaaaactaaaaaagtctcaagtttaattttccctgtaaaaaaaatcaataaattaacaattaatattttttgaaaaaaaatatgctatcttttatctttggtcaataattaaataataatgtatagacaatttttttatgaatatggaaaataagcacctcattaattattcttgaattgtatcacaccaagtccactatgataacgttatttatttacgggcacgttgattcaggataatatggacgtgaaatatggcactcacgctagctaccttgagtcattatacaatgaaatggataaggatgttgtggctgtacaatattcagtttttttttcttcaataatgaaaaatgttattgtggcaaaaaaaataaaattgcctcacattcctcacatcattaggatgataagtggatagaattatggatttgaacaaaattaataagttaaaaataattttaacttttaagtccgtcctttttcgtttgtgtgagagagatatgattttcattcaatgtatattatatctttatgtcttattcactattaacattaaattcagtccttaccactttaatctccagtccatatgaaacatatgctgtcttttttcacctatatatatatatatatatatatatatatatatatatatatctacgtacttcttgactgttgagctatcactatctatggcttcatgttatatatgttatgtcaccattttaatgactcattagacattttttttagcttgcagtgatagtgtgaaccttgtagatttatcatgtttatggactcttcgcctaattaaattctattttatgatatacatatttaataggattcgatataagctctgtttttatctctaaattaactttagacaacatttttacattctgtgtgtgtgtttttgtcaatttcgtctatattggcttctaaatataattgttaaggagaaagtaataatacttgaatctcacatgcatatatgtgtctattttgatcgcatgtgaatcacacattatttatattgaatttacaacaaaaaatttatttccatccttacaagtttggtcgacatttcactttagttactaaaaatgaataggcaaagaaaagttataattcccttgtgatcaagctaggtgggtgcaattctagctattcttgtaaattttcaggttgcttatgctttgaggttcagaagtattcaggaggtattgggtgatgagggataaacaacattggtgttggggtcattgcactagcgcgtccgcagaaacacagtagagaaggaccatcatgatccgcgaggaaatcatagctagcgaccatgtaaatcactgagttagagccgttgttgttggcctgctgttgcaattctgggttgtggcatgtactgctgagagaagatatatgcaaaacataacaagaaagagaaaatgcattggaaccaaagccattaaagacgagagagaaatcatactcttttttttatatttattttttaaatcagattaaatgttaaattacgataacattcttaaaataaataaattaaaatattaaattagtgatttttttggtcctacacagttttgtataaattgctaatacacatacactaagagaagatataagaatgtcaacaattttatatatatatatatatatatatatacccacgtatacatatgtatatgtgggtatcaaataagaacttttattattataagaagttaaaactctaaattcaaattgtataatcatacacggatattaaaaattaaaatttaattgtgcgtgacttttatatatatgatgactaatgaacttattatattgatcatctaggtatagttgtttgtcgtaggctaataatctaggcatagttgttggcctgctattgcaattctgagttgtcggatgtacttatgagagaagatgcaaagacaacatgcattggaacgaatgacattaaagacgagagagaaatcatactcttttttactttattttttttgaatcagattaaatggtaaattacggtatcatccttaaaataaataaattaaaatattaaattagtgattttttcatcctacacatctttttataaattgctaatacatacactaagagaggatataagaagatctttaatggtaaattctaaattgggatcttaaatcactttttgattgatcccataatgttacataggattaaagatgtatcaagatctctctcatttgtttctttagtgatagatctaattttgagatcttaagaagaggaagagaaaacaaattattcttttttgtagggaaaacaaattattattttttgaatattatacagatcttctacgagaactcattcttcatattaaaaatttgttcatatgctttattgaaaaatttagtgaaaatcaaattttgaactcaaaatccatactcaagatttggtactaaagatactctaattatgttatatatgtatgtcactccaaaaaagagttttattgccatcgttttgtttctttcaagagctaattgtaactctaacatctgaatcttgaaaatgaatttgctcaagtataataattaataagacaaaaaatatgtttttaccttattctgtttgtgtgaaagagtgactctaactgaagagtctattgaattttaatacaagagtgagcttaaaaacttgcatgtttccaaaatcaacgtatttatatgtcacaaaataatctaacaaattattaaagaaattactaaagagtaaagacgcataagcgtcatgaaatcctaaaattttaaaatccaattgacaaaataacttatttgaaatcctaaaattttaaaatgggtaacgagttaaacaaaaagtagaagaagaagaaaaatataacatgattaagcatattgaaaccaatatggaatctgctttacaaaggagacatatgaaaaggaggaatgtgatggagtgtacaaagtcaaaagctaaatttatggagcaaaggtgaaggtggctgaaggaaccaagcatgcacatgcacatggttgatgtttgttgtctttggtgcttctaaatgggcccacagttggcccagtaaatagttaagtgctccttgttctgttgttagcccaatatgagtcggaaaggtgcgggctgggacccaagatggaacttgcgtcacaaatcgtatcaacaagaataagaatgcttcttcattaggatcaaggttttttttttttttttttttttttttttttttataagtaaaacaactcaaagcatttcattggtaagaatagtcttaatacaagatgatatgtaataaaaaaaaactagtgactaacatgaaattgcgatgtctttcctagaagatgtacaatataatttgcttgtctcctaacaaaatactgaaaacagcaggatcaagcttgtaataaaaatatcagtgggaatttatattgtgagctcgtttatttaaatttattttgtaaaaagaatgtttttaatgaaataaacaattgtttttgtttttatatatttgtctaatttttttcttaatttaccccaaaaaaaataatgtcattgcatattagaattaaatccaaaggtctggcttgttgaatgtcatagaattagcaaatatagggtaaaaaactaatgatttctgccgaaagttaacttgcagcacagatactttaatgttttatgacttgagaatctttaaaagtgatgtttatatgatatgtttgtattcaaaaaaacattatatgtatttttattaattaaattaataaaaaatttccatgctactgtggacaggtcaaactcactatggatatacattcaagttacttgatgttccttgtgcataccttgctcaagaagataagattggtgagtaggagttgacgtacacattaaatcacaaaatgctactgtggacaggtcaaactcactatggacatacattcatgaaaccaaaatataattaatttatattggtagaataatagtattcactcttatttcaaaaaaaagatgaattaaagtcacatttaaattgaatatagcttaatttacagccatgatcttaggcagaaattctataaattcagggatttctgcttctaatagaccaggaacttaaactaaatatacatatttatttcactttttaatataaatttaacacatgttaatttatatgcaatagtttttgtatgcaaaatggaaataagtttgtcaaaagtatttatatatataaagaagcaaactacaccagtatcttgtgatattctttttcgaattacgcataacataattcttttttctattgttacaataatatccttagaaaacattatactaatacgcctattgtattacacaaattcccaataatatttgaaatcgttaaggtgggatattgtgtgtcattcggaaaaaaatcaggtgttaatgttaaaaaattatgaagaaggtaagggatgaacttagcaaaaaaaggggtgaaaacaacagttcccaaatgacagcaatccagcaaccgactaaagtgcaaaactgcaaatcgtttaccgcacagaacatttcagtgattcatccaatggattatccttgcacctagagattcaactcaacacttcagaggtagtgtcgattttggagattcaacactgtaggtaatctccttctgatttgaatgatgcatttgatttaacgctatcgacccttcatggtttaccaatcttctctcaagaaagtttttggtaaaattttgatcttttctaccctttctatcaacccttcttgcagcatgttgaagcgtggatacaaaccaaagccatggagtggagctcagaattgccgggtttctgtgttcctcatgtttttttcattgattctaatgttagtggttttccttttagtatttcgttatgacagtgatggtgctaatcccagtttagcttatgaacttcctaaacaaaaatggaatagctttgactctttggtgcatttgcatccaacaaaagagttccggaatggaactgatttgatatggcaagtgcctgaatcacctaaaggtgttctctttctggctcatggatgcaatggcagggcaatcaacttctgggacaagtcccctgaatgccctgattgcattggtttgcctgaggaacggttgcttgtactccatggtcttgcccaaggttttgctgttattactatttcaagtgcacaaagatgttggacatttggtaaagaagtgttggttgttaaagacattatagagtggtggattgatagaaggaagcttgagaaacttcctcttgtggctttgggtgcttcttctggagggtattttgtgtctgtgcttgccaccgccgtaaagtttagtagtactgtgctcatgattgctgaggggatgtttgagcaaattgatgttaaaggggactacccgccgaccctttttgttcacatgcccaaagatctttataggcagcagaaaatagatgagtatgtggaggttttaaaagataaagggattgatgttggtgttgttgaatgtatggagtttccattgtcaccaagtactttagctgatagaattccagggcttgatcaggctctttccagaaatttatttgagttctttcaggaaaagggctttattgataaaaatggttatatgaggaaagatgggcgtcaaatcaaatggaaaaaggctcttgaggagaagaaagctcttatgctggataagaatctggtccctcacatccaagaggagctaaaccttgcatttgcttaccatgagatgactagtgtgcattctgaccaaatttttaaatggtttgaatctcacatgagctcatcaaaacttacctgcattgaaaccacttgtatatgatggacctaaccttcgagtcaattttcctgaaattcaatctgagatccattgactcatgtaaaaactgctatagcggtttctttatcagagattgagtctcaagggctggaatttcttaattgggtgttactgtcagaagttatctatgtaaaaggtatgcctctgaacctttgcaccaataccatatgtgctttggcaagcagtatgctgaatgttatcctagattttgttaaaattgtaatctttctactgtttttttgagatttgaagcacaaatcattgtttaatctttgaaatttgaataccctggtggacttgagtttcaaaatacactttttaatatggctatcaaattatgagcctgaccctgcaagtttgactactagacttattttccctatgatctaaacccaatttgacatctatacttgaataaaatttaaaataagaaatgcaaacataatttttaaataagaactgaaatgaataaaattgaagcgagttttagatgagggcttctaatttcaaggtgaagaataatgacagtattttaattaaatgcatacaattttccttggtttttaccctttgcttgtattgatggtgagaggtggaaaggagaaaaattatatgagatagtaaaagatgccattctttggatgtttagaaaggaaaaggaatggaatcaaggagactcctttccactccacacctctctattcccttcaaattgacaggggagtggatggaataacttttgaaattatcttttttgccattcatcctaagatttaatgtgtttgatatgagggcaccatgggaacaatgaacttgtaattcttttaattccactcacttctactgtaattatgaatgggaagtgggaactttcttccttcctatcagtaaacatctttactatagtattttgagagctttcttcctttctaccaataaacatctaaattcttgtaattatatggtgctgtttttgtccctgcaagtggaggttctaagcacaagaatgctcctgaaaatggaagtgatgtggggtgaaaacattgtatattgtatattgtattttatgtgagatcttactatccttgttaggatcttacaatatacatgttcccctcctttccaatcctaggtgggatctcaatttgactaccttggacatatggatgacttcatattcctcttgtttgtcatcttaagcattcaaaagcttttggagcttaaaagttatatacacattggaattcttaaaattaaaagttttgggttcattcggataaactaaaataaatgcttttacatataattttcttatagttttttttatctagaatatattaatttttacttgtgaaaaagaaaagcacaacccaactttttctctgaggcttttgcttttttttttttttctccaaaaaacttatctaattaacataattttttcaaacatattttgaattaaaaaaaatactttctttttaaatcacaaagaatttgatccatgttcttcgttttattccttaccattaacacaagtaaatatatcatatatagcaaagcaatataactttctagctacgaagtgcactagagtagtagaggtctttaatatctcagttattatgttgctcaaaagtatttggtaagttgaagacgcgttttgggttttatttgtgtttgtgttttaaagatataatgaatctttttacgttacactgggaagactaaactagtagaggtctttaatatctcagttattatcttgctcaaaagtatttggtaagttgaagacgtgttttgggttttatttgtgtttgtgttttaaagatataatgaatctttttacattacactgggaagactaccctccttttatagtctttacctgccggtgtaattgttctggaccataccacagccttgtacacttccccttgaggcactttaaaagacattaattggagctcacatggcgctttaatccttcctctgccactgtaacccatcattcccaattcacataggggcaccattgccagcatcttggtccatctattgtctttgtttgcatatatattggcaacaaaaccgttcccttgaatttcactaggaaacaattctagacaacttcattctttacagtttgtaccttgttcacgttttcaagactcaccatatcattcttatctcttgaatgccatcatgttgcatgaacaatcgacatttctagactagggctatttctaaattacactttatgggtaatcaatttcttttgatagattatgtacatccttataggtggaccttcattaatgagaagatgatgcacccttttagtgctgtacttataacaatcctcagtttttatttgatgaattatatcacagattctgattttgccttccattttagctgagttgaagtgatttttatataatgaaataagtttatcttaataagaattttgcattttttcatatataatgaaaagaagtttgtactttcgaatgcagatataattgaactattgaagtaacaatatataaactttattacagaataagaaacgataaaggctaacatgaacttgtaaagtaaaacgatatccatattacacaagataaaagcctaaataacacacttagaataagtcttagacataatattcttaactaaataaactgacacaaagaccaaattaactatatcatgctcgaggcttcattcgcccctcattagccatcttgaagaggttggcttgtgctgctgctaccttatttgaggcaagagatgctataaatctgtctctgacttgctgggttgtataagggaacctgttgttcaccaaggaattaagaaaggaagctgtcccttctctgtagagtgctcctagcccatcagttctagtgttggaaagtgcttgtggcaagctgagactggcaccaaatcctggcatactagagacaccaaatgtatggcctaaggttccccaccagcctagcaatccccaaatgattcctgggtgagtgttccagtagctgcaatttagaggacaaggtcccataggttacttaacagtgtggctgtatatcatatcatagtttatagtgcaatgtagtgaaaagaagtagtaacttacttgcatgtaccagtgaagggagttggggaaggaaggtaagggggtgtggaggggatagtgggggtgccggggtcaactggggttgaaggtgggctcacagtgattggtgttggggggctaccacctccataagttggtggtgagttatagtacccacctcctcctgagggagggtttgatggtgttgatggggttgatggtgttgttgggactgagggtgttggagtagaggggtcatgtggtggtgtgccacagttgctgcctgagggtggtgatggggttggattgtaatttccaccatccgtgggtggtgatggggttggattgtaacttccaccatctgtgggtggtgatggggttggatcatagcttccaccacctgggggagttgatggagttggattgtaacttccaccaccacctgaaggtggtgatggagttggatcatagcttccaccaactggaggagttgatggagttggattgtaacttccgccaccatctgagggtggtgatggagttggatcatagcttccaccacctggaggagttgatggggttggattgtaacttccaccaccacttgagggtggtgatggagttggatcatagcttccaccacctgggggagttgacggggttgggttgtaacttccaccaccacttgagggtggtgatggagttggatcatagcttccaccacctgggggagttgatggggttggattgtaacttccaccacctccatgtgatggagatccatgatgagagggtgttccatgatgagagtggtgtggtgagcttccgtgcccaccactcccagagccatgatctggagagcagtatgaaccttcaagaagtaaaagcaacgtatactattagattttaaagttaaatgtcaagatagtttctttaagagctcttgatcgttcatacgtcaaatttgaaagtaaatggcctactgtagctagcaaggaaatgatatcttctattttgcataaataatgaagcaaaatgtatagttgagtaagagaattacatagagaatttgataaatctgttcctgcatgtgggtctggagagttgtagttcttctggtccacaatgatggcagtggtagatactacagggatgacaaggttctgagaaagcactccaagtagcaatgtgaacatagagaaagaaataggactgtgtcttttcctctccattgtcactgactgcttagaacactatgagaaagaagagaaaggggggtttgagtttggagaggggagtggactgggaagaatatataaaatggttcacagagtggagtaaatattagcaggtggaggagtatgcgggttagttgatgttttgcaggagcatttactccgtatttactactacttcatgcaataatgcctgagttttctaaaatagctttaaaacacacaacgcactctcctaactctggcctttggttcttgttgatcataagcttgagctggattgtactgaaattactcattagctttgagtgttgcatttgtcttattatggtattaattacaggcgtaaaccagtttatattctgtaagcttagtgagttatacatttatttaaccttcaataaatcaaatcaaatcaaatactacttgacagagaaatctccagcacccgatgcatttattggggctaatggagacgtgccccaggaataatttttcaatattatgccccatgaaagatttctaagtatttattataatgataccctcaaaatttgccggggttgatctacgtaatatatagtcatttgtataatatctatgtatgtatactcaaaatttgccggatttgtgtacatatttgacggaaagtattggcggtgatcactattttgtaccaagtctagcacataaattgcaataaatatatgatatttatctgaaaattcttttttttattattttaaatactactcacatttttatttgactttataaataacaattagcattttttttgtacaattatcattctattcaatttaaatatattttagtatgcaaattcaatatttatgtaataatcattttgcatgaaaaaaatatattgaactaaggcagttgaaaaaaaaaaagagagagagaaaagggaccctaatgtcgaagattacaagtgtgagtcattccgaactaaatgacaatggcagagggtaggtgagtttactaaaaaaatgttgggagagtagtggatacgagtggtgtttccccccatttttttgccggtaagattacaagctgtcctcacattttgatattactcgagcatcgattttgaatttgtatattacaaatttgtttacatatactctgtttactaaattttttagaagtatttatagcaactcctttcatggaattataacagattgtttagcaatagagttgccatgaattagcatctttagcttttgatttgcatgagaaatactggatagatgaaattcccttccaagtggaacattttgtgtctacaaaggctaaggctgggtgtgtttggatttccggtgggagcgttaaaagtatgtttaagaggaaaatgagtttacaattatgtttaattaatctccaaaaatatatttgagactaaaattttgtcttgaaactcagttgtaaaaaaataatatttgagatacttttgtaaacttaagtttaattcgaggcaactagggcaccttttttgtaagagacgctcagctcaagtcaacttctatcaattcaggcggaatttttcaaattttaatctaaacatacacaaatcattcagtttctactaccgaataacatctagtttttcagcctcaaaagagaaacataaaataaaaaataaagatgtataaattaattttaatttatagagaagtttaattaatacattttactttttttttctataaatgtttatagaaaaatttatctaaacatatccttaaatatttgttgatataaaaacataaatgtgtgtgcagactgtagtgtataggactggaggaaaacaagttggctgtgagcctgtgagctgtcgcctatggactaaatagaaaagacaaagctgttgtctatttgtttgtaaggaagtaaattgctattgttaggaactggaaagtctctcatcaatggagttgtgaacttttcatggattgtgactgttttgggactggtgcttcgggagggacatttctgagttcatcgttaaagcttggatttgtatattgttcttcatcaataggacataaataaggatttggatttttctcttttcatgtttcttagggtttactatcacgttgtcctactactttatgacatttatatttaaaattgattttatatgtaaagttaaaaaaaactaaaaaattgccaattacatgataaaaaaatttcggccataaacagaggagcgtacactaactggcccttgagctatgcattgggtgaaccagttgaggacaacgttttctcgggatctaatattgatagttttatatcgtgttagatttgttaatttagttaccacttaccaaatacttatctggacaaatcacatatacttctctaattttattttttatcaaaaaaatttaaaatcaatagacacttaatattgtgtacccatatcctatgttttagattttaatgtgtccgtgttatatctatctccatgtccgagttagtgtttcatatgtttcaacaccttttcatttgctggagtttcaatttagattttgtgtgcctactgccttggtaaacatacattttggactttggaaggagcaccttctctgtttgaagtaaataaatattcatgacacataaacttttctatatgaatttcaggagagaatgcttttcatttgtatggtgatatttttttttcttaacactttgatttaccagggagaaagtaagaatcttgactaattaagttcgattggaaggtaaataaaatttgattaataattatttttatcaatgatcgagtttggatattacccaaatgatttaatcttaatttcaacatattaatcacttatgtagaatcattgattatggttatataaaatatgttcatatatctgtattttagaaaattattcatctccaattcatttttatataggtagcaatgctagtattcattattcttatactttatgtataggtagacactcgttttcaaattcattatctacattttaattaattaatagtactattttatatgataattaagaaacataacaagcaaaatatttaactaaatttaaatccaacatactagtggattcaagtccaaaaaaatgtagaagaaaggtgttttctgttttttgcataaatttatcagaaataactcattttacattggtgaaggaccgcacccttctaaacaattaataattcctgaaatattggttacaggtgttgggcaaatctcggggggaagtgaagctggaagatgactaataaataacaagcccataggtatccattatgttaattattaacggaataatcattattaaattatgtttatgataataaatttacatgtgcacaaaaaaagtaatgttatttttatactgtaacattgtatttagaatatttttataatattatttgacctggactgttactcgacccttggtctatttgattagagtagacatgttgacccaaaaactatagaagtacaattcatcactactcaacaatgtttaattttcctcaccacttcctaatgttgcgtacacaagagtcaagagctcatacgaacgtgaaatgctgagacatatgacataaaactgttagcaatgaacaaccccaaattgtgggattaagcgttcgtcacattatcttgcatgagaattatcgtcctagcttgaagagagccatataagtgtaagcccaaaatatgcacactcaaattctaatttacttcaccatctatgacatacattgtcttggatagtagtagtactctggtggagtcttacaagtaattaccctagagtttaattcgtaaaagaccattgaagaattcaaattataccttgaatatttcacctaaggattggaagtaaacactattttctctatcttttttcttcacattaactacctcatcacatttttttcttttcgtatttttttttattgttcaaaagataatgctttcgatcgtctaatctgcataagttttgataattaagtcttggctgtattgaatgcaaccgtctaacgtctctgagtctatcacatgctaacaattatgtctataggaagctttccctcctgacataaaagttgttgcttccttcgaagtcctcagtctcaatagttggcaatatgtttcggtggtaaccatatggctgtgatagaatcgacgagcttattataccagattggaaggaccatagcgttgttaataagtttcttttatttacttaccaaaatagacgagttgttaaagagtgaaatttggtttatgaatgcagttgctatggagccagtataggcaaggttccacgacaaaagccaggtttacttctattttaactacagcaaaattatactaatgtttagtgaaatcatatggaataataatagaggtaattctctcaaaaaagtcgtggttgatcattgttagagtagaaataagttaggatgaacaaggttttttttttttttgcttaacatggtattgaaacgaaatacctaccataaaaaatagtgactaatttttgttagagactaagcatatacctaagatagatattctctttccagcatggagcatttatatctaatattggagtttgatccctaaataatttgattaagtaacataagctattatcatttgtgtcaattattgatggtagatagatttgatctgtttaaaagatccaaagcctaagcctggtatattatttattataggtttatttttttgccctttgaaagcctgatttatctcattaatctgtttaaaggcatgttgaatgcttagtcaattggccatgtgtggcctgagtctcggctgaagaatacacaatctctcaagcgctaaatctaaaaggcatagacaaatgttaattttggttaaacaatttacaatccctcgtatgctaaacatgaaagacaggcaatttattaatctcagttagacaatccataacctcttaaacacctaatcaaaaggtgtaaccaatttgttaatcttggcccgatgattgctatagtaataatctaacaacgagtcaaaatttggtgacattgagcaaatacaaatcttgttatttttgtaatcataatatttcttgtaaaaaagcaactgtatacaattcattcacagcttgtttatagagttcctttaacatatgaaatgatgaaccttctatgctaaacatcccccaacaagcaataaattcacaaaatccagctttctaacatgcatggaaatgatgctgatttaatttatcgccatgctccgaaaactttgtttggaatgttcaacgactgtgcttaggctgttacaaacaacattatctccaacattatcagcctacctttctaattactttaagaagatattttaaagttgagattcagagacggtgattctgcaccatcagacaccaatcagtatttacattgctgcaataatgagcaatcatgatgactgaaacatgatccaaagtcacatgataaaacaacgagacttcacctgcagatttttagggattcttgggtaactaaaaagcttctagcgttgaccatgaagagaaaaattatttttattttccatcatgaatttctcaggtatattaatgatgattacgtgtcattcttttcggacaatgaatctattacagaaaagaatcctgcagtattcttttcacaagctgtggtgctacagtattattttttcttcttttttttgtttctgtcacaaattagaaatttattaggaaggaattgacttctaggatgatcaagattataataatcgtaaaattcatttgggtttgacttcattcatcttcttccacaaaccacaggttcctataaaaatgtgctgaaccaacacttgaatcttaaaacaatttatagatatgaacttaaatttttccaagtccttgatccttacaagttcaccaatatttggggatattatctattttattttgtggggtttgtttcccctactacttttgctagtctctttcaatttcttgagacacaagcaatgctacaaagacaaaagaaagctcccccccaggggaaatggggtttccattgataggggagaccatggaattcttcaatgctcaaaggagaaaccaattgtttgaagagtttgttcatcctcgcattctgaagcatgagaagattttcagaacaaggagcatggggtctccaaatgtggttgtgaatggagctgaggccaataaattcttgttgtctaatgagttcaagttggggaaaatctcttggccttcttcctcagttaagctcatgggaagggactctatcatgcagatagatggggcaccgattcctccgtggtgttattggcacaagccttggttatgctggacttgagctagtagttccaaaactgtgcaattttgttcagtttcacttagctacaaactggaagggccaagaaaagattagtctttaccgttcaacaaaagtcctcagttagtgtttgagtggttattaggaatcaaagtggagccaggtatgctagatacctttgaaagagtgttggagggagtgttttctccagcagtcatgtttccaggttctaaattttggagagcaaagaaggccagggtggagatagaaaagatgttggtcaaagtggtgagagagaagagaagggaaatggaaggaagcatgggaagagaacaagatggaatgctgctgtccaaattggtatatgggatgatccaaggggagatcagtgaaaaagaggtcatagacaatgtggtgctactagtttttgcagctcaagatactactttttctgttgctatgacattcaagatgttggctaagcatcctgatttctttggataacttcatcaaggtaatctaattctatcatcatacttaaattagattttaatttctatgcattatgtcaaaaaattacattattaatcaatcaaaaatcataatagatacgacttttaagataattatgataaaagtaaaaaaaaaaaaaaaaaaaaaaaaaaaaaaaaaaaaagcttaccatatatatcaaattataattaattaatattcttaaaacttttcataatgtaagtgtatagactatttcctctttaaattatccaaaagtatttagagttgatagttgatagtttgaagttcttattttatgcagaacatgttgctataatgagcaacaaaagatgggttgagaatctcacaatggaggacataaagaagatgaagtatacctggcaagttgctagagaaagcatgagattgttccctccaatctttggttctttcaggaaggctattactgatattgaatatgaaggattcattatacctagaggatggaaggtgaatactactttcttgtttccttcttaaatccatgcatgcatatctcataatttgtcaattttgaattaaatcatgtaacatggggtttcttgtggctcttctcaggtgctatggacaacatacgggacacattacaatgaagagtattttaaggatcctatgagtttcaacccaagtaggtttgaggagggatcggaataccccaatatgcatttgttccctttggaggagggccaagagtgtgtgcagggtacctactagctaagttaaatatcctcatatttgtgcactatgttgtgacccaatatgagtggttcttactccacccagatgagccagtcgcaatggatcctttgcctttcccttcccttggaatgcccattagaatttctcccaagtatacatgatcatacaacctcaaaatgaatttgttttacatataaaaatattgtactcttggaacacacattaccaataagacaataattaatattattttgtttcctatcgtatgctgtccttgaattgaggcgtttgcacatgttatttacttgggtatggatccagttttcgactagatttcgaaggaaattcagaacatattataaaagatgcacatgaacagcatctttggaatatactagttaaaaagaatgtttgggaaacaaatccattgaagatcacaactccagaaaagatattggtgttacgtacatttcagcatttccaaagtaaatggctgacatgaaataattgcgaaaagtagtaactgatgaaagacgtgatttgctgtgcttcttttaatttatcaaattcttaatcttttagaaccgtctgatgtttaattaaacaaggatgaagatggaaattaatgaagtgggcacgttcattcattagtcattactatatgatatgtactacgttatacgttacaagctaggacactatttataatagacaaactcgcatggtctttcacacatagtatgaatgcataccaaacatgaacatatatagtggtgtatttcaaaagataacgcgtttacaatttagaaatgaagtctctagcttcctcacctgtcaccatcatcaagtattaaatatcaaaacaccactgagaagagaaaacggatgcactggaggtcaaagtatgatagaacaaacatatcaggcatatcatttgtgatcacctaatcactgagaaccaaatgcaaaaaagcttaaaattaaacctttttaacaaattgtttggtttaagaaaatacttttatatttttattttacatataaaaatattatattattttttacgtaaactgttcgaacttcctttctattttacattttttagacattttttctatgcaattaaaacctacacaaattctctccatcttttttttggggaatggaaggggagacccctaagaacaatccattaaaaatcacaagaaaacgtggtagaggatacatctgtcaaaactacagttgataaaaatagagggaataatttcacaaattcatagctgtttatctaaggacaaaccaagcttagctaaacaatcagccacttgatttccttctcttaaggcatgatgtcacgaaatgctacctccaattaagctctaggaacttcagtatctcgtgatcgacttaagcatggatggtaagtattaagtaggacatccagtagtgagcaatataatggctacttgcgagtctgatctacttgaaactgttgaaaaccatgactccaaacaatctgcacactaatttagttggtccacaattcatctatgacaacagaacaaaatcctatatcagcagagaaggagaaaataacatgacccaaggaatatgatacacataaatttaaaacctttatttttaaataacaagaaaacccttcttacatattttgactaattacataaaatcttctatctataaggtagcactatttgaaaatattaaaagtaaacattattaaatttttaattgaatttttttatattagaataacataaataatgaaaaaataaaaataaaaatataaaatatatatattttataatgggagaaattttatataaattaaaagtataaataatttatgtaaaaaaaaagtttaaagaattgaccctatttttatttagcttcctatctttagataaaaaataaaatgtgcttgtactcatttatttggaaagtttaagattctgatataaatgttgttaacacagcttgatgataacacacttattggtgagtcgtcaatccgattaataactcaagaaattcaaatgagctctattatgcatgatctcatatgatcaaatacgagccatgcctatttattgtgtgtattttgtcttgactcttgaccattatattgggtccaaggattagatgtccatccatcttcaattggacaattgagaatcactcaaacgtcttaaaagcacaaatgcttattaagctgtatgattcacgatcgaacacttcacaatcccttgaagttaagctgtatgattcacgatcgaacacatacatttgatgatccacaacatggtcaaggtcgagattgaaaacatataactcactattaagaagtcttgaatccggttaacacttcaaaaaatccaaataaacttaactacacgtgaacaaaggaattataactattttatagagtatgcctgaaagaattattatattgttcttattctaccttacttatgaaaaagactttgatggaagaaacataatttatttcaataatctttatgtctcgtgaattaatctcatgacttaccattttggaatataacccttcaaacatcaattttagaagaaacgtactttttgtttgctggatgagatccacggtctaatactacccagatgtaaatatatggatcggaaatgtaccgatattactacttgtgtgggtctggggaggaagacttagctacacgagttttctgatacagttttgactatatgcattgcacggcactgatatgtggcagagtgctctgttgtgaacgtgaagaagttaagatggtctgtctgaattgccacccactgggggcacctagctcaccaccaccatcactatttgacagctagcactgcacaataactacttgatcgtgatatatatttgcaccctcaattatttacattctattactccaatttctagaattttgttcaacttctataccaagagagagcctttggtgtgagtgtgtgtgaccatcttgctgcacatgcaggaactcttatgcagagtttttttttctataaagtagaaaaagtaatacagataaaatacaaaataaaataaaaaaaatagcgtacaaaattgattttcctaccttcaagtcatcgagccaaggggcgctaaatttagcacacactcagccgccagcaccacgtactaacgtagttttgtttgcgtgtaccatactctgatactcagtacttttccgcaattttcatactatttgggcaaaaattaataaataatataaattaattatttatttagcaaaaaggagtaaatgggtcaatatttagcaaattggggcactcaatcacgcccatttggggcatgtttaaacacgcccaaatggggcgtgtttgtgcacatggtgacacgtggcagcaaaaaaagggggtgtggggttttcgcggtgttttcgtaaattacggaagatcataacttttgactgggacgtccgattgacgcaaaaccggtggccacgcgctcgaaatcgagaggagaagccgctggcaagtccccgaaccaaaaaattttcccaaaagaggtctctaagtgcctcaaatttgtgatttaatcttcggagccctaaaaaaatttttgtttcctgatattttgtccattcaatcagtaaattgcaagctattctttatttatctaattacttctcttaatttcgagcgttttgacataaaatacgtctccatcggacattgttacgacaaaataacgactgttcaaagttatatgcaatgtcaattctacactatatgaatgttgaaccatttatgcatttgtttagggatgtgggttaattaactgttggatttggtttagggtttagggttttagggtttagggctttgggttaatgattaattgttgatgtttgttaagttgatggggcgtacatagtaggggattaaagggttactctgacgactatgagcatgagctgatgaagaacatgaatgggagaaagacatgatcacacgttttatttcttgttctgttttgctttttatctgtgtatatgatgatggacttggcacaagttgaaacaatgtatgtcaaggttcttactgtacatttttaaatgattttggtttaatgcataaatggaacaaacatatagtgtagaattgacattgcatataactttgaacagtcgttatttttcgtaacaatgtccgatggagacgtattttatgtcaaaacgctcgaaattaagagaagtaattagataaataaagaatagcttgcaattcaccgattgaatggacaaaatatcagaaaacaaaaaaatttttagggctccgaagattaaatcgcaaatttgaggcacttagagacctcttttgggaaaaattttttgggacttgccagcagcttctcctctcaatttcgagtgcgtgaccaccggtttcgcgtcaatcggacgttccagtcaaaagttatggtcttccgtaatttacgaaaacaccgcgaaaaccccacaccccctttttttgctgccacgtgtcaccatgtgcacaaacacgccccatttgggcgtgtttaaacacgccccaaatgggcgtgattgagtgccccagtttgctacatattggcccatttacccctttttgctaaataaataattaatttatgttatttattaatttttgcctactatttgactagtattatttatttctttaaatcattttcctagtgtttaattaattaatttttttatcatcaaatatatggattaactgatttaaaaaaaatcagtttaatcatagatcttaagttcagatcttaaatatgtaattgtattaaatactattttttaaatcatttttctaatatttaattaactaattcttttcatcattaaacatgtggatcaacttatctaaaaaaatttagtttaatcataaatcttaagttcagatcttgaatatgtaattgtgttaaataattaaaaaaagaatttttctgtctataataattttatttgactcgaacataataattctacttgttcaaacataattgtctttcctggaagatgtatttaactgggaataaaataaaaaagtctttttataatgatattttttaagatttaaacttttaatattacaacttattgtttaattttaatctattccgttgcatgtttcgaagggtgtaatgtgggtccagtccatactacattttttattattaacttcttttgggcttttgatttgtgtaattttgtaaagacgcaaccatgtaaagcccaaaaataaaaattgccatcaaaaccaacttcctccaattttttgccattgaaaattatttggcattaacttcctacaccagtaggatttctaatacacccagcatttttattaaatcccgataatacccctggttgctttttaacatacaccagcagtgtccatgctttttcttcatgctttttcttcactcttcttcgttggctgttggttgtggcttcgtcggcattttggaagtggtggttagctttggtgtagtttccgttggccgctggagtcgtcggagggtcgtcggaggtacgttctggtttgaatcgcaacccgtaatgataatacggattggcaatccgtatggtccatacggattgccaatccgtaaggtatttttttaaattttttatttttaatttgttaaaagtattattaatttaatgtatttgtcctattttcatttaaaaatatattgtgaagttaatattttttgtaggatatttttttgagcatggttgttatgcatttagttttttaatgatggttattttttaatttgtttgttaaggtggataatgataattggatgcatgatgatatgatgtctaaagaaatgaatatgagtcaacataagctggccatctacttacagtagtcgaatgcagaagtataccagcttgacgactttgccaccagcttatgttaatctgggctgttatagggggtctcaacactggcgtacattgtgactttatgtagttttttcatttgtgttcacctaattgtacgtcggttatgtatttgtataactggcacataattttatttcactaaactaaatactgacgcagatggataatgttcaaaccatgtaaatatatcaaatgaaatgtttcaacaatatgacaatgtaaatacatatgtgtatatactgctacacgaataatgtaacaaatcaatctccacgcgggccagtcctacgacgtctcgaccgcacatacactcttcgatcgtcgcgtacactgcgtgccactgtaatacactcatccacaatgtcgtaggtttcggtgtcgacggtcaccatgcgcagatctataagtctctgcaacctatctgcaatggtttgaaaggctccctgcaaacaagttcgaataaactggtcaagaggtcaccaaccaataaatgatttaccatttatgaatactagaatgaagctttcattttatttaccactgcatgtcgaggcatgtcatcctgatcatctgcagtgtcaactgtggggtctgacatgctaggaggtgtatcaggtgcggggtctggcactggaggaggggctctgacttccccaggctgaggcgggcacatgaacgggtgcgatatctggtagaaccagtccatgtatgcagcatcgcactggccggggtaactggaagggggtcctgtgataacaagatgttgtgcgtactgaagccaggtctcatccacctcttcatctaacggggtgggcaaggtgagaagagacgggacgctctgaatgaagccgaactatctgagcgccctctctggatggtacttgacgcagtatggaccccatcgaatatggccggagtatagacagatcacctcaaagggacaggccgcacggtgatccgtgtatggagtccaacagacagcctcgcttgtcagcttatctaggcgcctccgatacgtactgagaggtaacgccttccccggcttccagcggcaggcccgtggctgactctccacataatcctcagctgcaatcatgttggcaacggcaggaaagtgctcgtatacccaacacttaagtaaacaaaataaccaaaaacaaataagctgttgaaattcaaccaaaacattaaataaataacaaatattaacttatatattaacaaaatacctgaagcagactaatataaccagcaagatgtttaacatgatgctgacaggcatagttcaagttatcatacatgtgttggagtgcagtcgcaccccaactgaacccgcctgattggtgtagatcacgaaatgcctccaagaataccacaccaatatgtgtggcactcttgttagcgaaaatcatgcaaccaaccaaatggagcaaataagctctggctgccaccgtccactgcatctgctgacacctctcagcatacaagtcccgcaaccatgacagacgaacataagctccatggcactgtttcgtctctgctgcagcctggtcgtgggtaacctcaagcaactccacaagcaatgcaatggcctcatcaacatccaaaggggcgtatgtctgcaacgcacccatgactggtagatgaaagagagatgcgacgtcgtccagggtgatggtcatctctccgatgggcaaatggaaactactagtctccttatgtcacctctctacaaatgccgagattaaaccccggtcacctgtatctaccgaacaggtgatcaatgggcttaatcatgtacctgccaccaacccttcaatctcaggcgcaggccggccaaacttctgaaccttcctcccatgggatgccaacttcagctcgggccgttcctgtattagtggttagttacatacacataccctaacgcgaaaacaattatcaaattgaactatgtttaaatacaatcatacctctcccctccaaatcctaggtgcaatatgctcagcataatgagttaacactaaactgtcatcgggcccaccgaaaatccgtcaacatcagaggcatcgatgcttccctccacctcagcctcaactggtgcactatgctcaacatcgtcagcggctacctcagcaggcacgtcctcaacaacatcagtcctctggcgttgtctccgtgctaatgctgttggtcttcgccgtacagcgggttcttcttcactggcatctcttgccaaagcccgccgtaatcctatagtattagccataatctgacattgaaaccaagtaattacattacaatcatagccttcttcatcaaaataaaactttcagataacgatacctatcaaacatacccatgtggatcagaaaccaactaccaggtccataccattacacaacattattttcaaataacagttcactttactcataacaattcaaattatgtagaaagtgtagatcatgaaaccatagccatgtggacgatcaaaaacaatctagtaaatccataccattatgcgcatgacatttcacacaacaattttcactacatggttttcacataacaattcattgtggctatcattttgctcatgacatttcaaattacctaccaaatgtagatcatgaaaccataggcatgtggaggatcaaaaccattctgccaagtccatagcattatgctcatcacatttcacataacaattttgactacatggtttacacaacatgcttttaacataccaattcattaaatcagttcagttcattcatgcaaaaaattcttgagccatcacacttaatcttcaaatttaaaaaaatcaaaaattaaccaaatacccatacggattggcaatccgtaaggcatacggattgacaatccgtaaggcatacggattggcaatccgtaaggcctgcggattccaatccttcttacggatccataatccgtacattccacttgatacggattctcaatccgtacgcatgcaagacaaaacaacaagccattccttcttacggatccataatccgtgcattccacagcacacggattatcaatctgtacgcttgcaagacaacgaaaagcgaaacggttacttacctcaaagcgccggaaaacaggaagcccttcgtcgccgacaaccaacaaccaccttccacagccggagagaggagaatcacaacttggcaacgaccaaaatcgccggaagcacagagaacccaaggagaaggagaagaagcgccgaatacgaatgaatacgaatggattggtgtattagaaatttgaaaaatgcttttgttttattattttaagcaaggctatttgtggtatttcacaaatacctgctgggtgtataagcattttgactggtgtaggaagcaaacaccaaattatttttctttttttcttcaaggtccagcccatatatagactacattttttagtgttaacttattttgggctttgacttgtgttcaacttaaaattttgtccacacatatctatgcatcaaaaccaattctcctccaatcagaactttaattttgtgattaaaaaacattttcttcggttcttccagattttgacctgtaattgtgacagcaatattgcgcttgaggcagttaccacaaccacctttgacagctaaattgatatgaatccactgcattttactgttatcatctcaattcgtgaatgcaacatcactttaaataccttagtggattcatattttttcagataatcaaattaacatggcttcttcatatgttttattcatgctttctctcaacttcttagcctcaacaacaattgctttgggtgggaatttcaacactgattttaacattctctttggagataatcgagctaacatacaagatggaggctcaagcatgtcccttgcaatggacaaatcttctggctcgggcatagcaaccaagaaggagtacttgtttggacaatttgacatgcaaatcaagcttataccaggaaattctgcaggcactgtcactacattttatgtatgactaacttgttccaagttaacccatcattcacttgcttattctctcccatccatgcatgcacacacacgtaaacacattacaacatacacatatactacataatatattgcataatattcatgcatattactttttcatatatatatatatatatatatatatatatatgcagctaagctctcaagggccaaaccatgatgagattgatttagagttcttgggcaacttatctggtgatccatacattctctcaaccaattattatgccaacggtactgggggtcgtgagatgcagttctatctttggtttgatcctacacaggacttccacacctattccattgattggaacactcagcgcataatgtaagtacaaaataaatttatgcataaaattaagaatttaatttatatgcactcgtcgttataaagctttttttatacatagacgtccaattcattaatatggcctagtcatagaactaattaaatatcaagatgcaaaaaattattagcagacctgtttatggtgccaatcttaatttatatgtaacatgtatttaagttatttaatttataacacttaatatacatataatgtaaaaattaattgaaaacataatgatctagaaccacatacttaataatttttctggagatacatgttgtatatgtaaaaaaacttttattctatcaatcaatcaaaaatcattgttaatattactcgataattattataaaatttaataaatttaccataaataaatatataatgtttatacttgaatgacagttaaaaaaccttttagattgcttgtgaaattacaactcattcaatagtgtaaggaacaaaataaatttgtataattctacttatgggtacaatatagcataaatgtgtgtttttcttttttgtgtgtttgtagaatcttggtggataacacacccatcagagtgatgcacaacagggagagcatcggtgttccattccccacaagtcaacgaatgaagatttatgcaactttatggaatggagacttttgggcaacaagagggggcaaggttaagattgattggtctaaagctccattcatacattcatagcaggtttcagaaatttcaatgcgaatgcatgcattgctggaccagggacctcatcttgcatgggtttcaatggtggaagaaacaaaggtcttgatgctcaaatcaggaagcacctcaaagagatccattcaagattcgttgtttacgactattgccgcgatttcatacgttttgctcatggttttccacaggattgccgaaagaataaacacttgtgacttcccattaaaggattgcttgatcattatgttcatgggcaaaccatgcatgcatgattataatgtacactgaagaatttttttattattttagaaaagtataaatgttcagtgaaaatatttcattctattaaatccagaaatatgtacgtagtttttctcaatcaaccattgacatctactgttaaaaagttaaatacatttttaatatggtttatgtaattaaccttaattacgcatgtcaatgatcgttttgagtgcatataaaaggtaatacccacttaaaaaaaatcaatttcgatagagttagaagatctttatatttgttcacctcaactataaaaaaaaatagaagattagctttgaatatctttcaatagatagaataatgatacacatacataatccattttaaatatttcaccaatatttttcatttctttctatcatgtcataaattctattatatatataatttctttttctttttcaactctgcatctaagtgtaagatagcattatggatttttatcaaacattttttaaaatgggatgaaaagcaccgacaggaggtgctaaccatcggcccataaagaccaccaattcagcatggtccttctatcccagtcttcgacttcttttgttaggttgaacaattgccatatttgacagctcaatagataaagaaataaatgtatatctaacaggataaggagataaatagaatttaaaaactattaaaatgagcgttgtttgtagttatagagtgtgcatatttagattatacacttattagtcttgtggttagagaaaaatatcttactcaagaatattaatcaaattttttgaccaagattaattactgacaaaatctatatatattttatatcaccaacagatatcattcctcctaaaacaatgttctctttcaactctttcaactaatttatgcgtccctagagagtggctttttgataaaactctaataatataatagtaaaaagatacttattattagccacttgcccaagaggttttttatacatgacatttcataattgcagataatatacaaaaaattatattgtttttacaagtactaaaatggtacattttaataagattgtttttatgcttgttgcttaaaaaaccctttataaattacagcttttttttgctgattttaaaacgtacctctcacgtattttcaatgcattttttatttgcaacgtttcactccgaagacaacaaattaaaccatctaataaattttggaaaatcacaacaaaaaaattaaggaaaattttatggtgtttacatatattgaaggatattgataccttgaatagaccaataaataatagacattaatttgtacttgtaacttttacctataggtaatatggaattgataatatgacttattgtttagtatcttgatattttgtaattgttaaacgggccttgaattactttgttgcccattccatttacagtagtacatttttcatgtttaatattttaaaattttgaaaatatgtgtagttataaaatttaaaacaccattgaaattaaatgctaattaatttctgatgtgattttaatattatttttttattggtacacaaaggtactaatactctcttaaaaattaaaattttaaggtaacaaaacaatccatatatcaccttatttaaaacaacttgaaggaattttactttagatgaaaattgtactccaaacatagtacacatcgttacacgcacactcagaatatacttcaagttgagatggaactgtttttaacgtttcatcatcacttgagttccctccatgagcgtttcaattcaatttaaaagcacttattctttatataagtaaacagaagaagcagaaaaagaaagaaagggaagtcacatactgacgcacacactgctataagtctataaccattggcattgacaccaacaccaatcttcatccaccattctctggaacaaccagtcagcgtccatgcctccagcttcaagaaggaaaccaaaacaagccaagaaacacaaaactgtgaccattctcaaccaccattcttctcactctgatcaactccaaggtaatcactctttactacactctctatctaccttccccagccacctacattttgttgcgtgtcctctttatctttatgtccatctgttctttgtacatccttgttgggtatcctatgtttcttattgttactttccttaatcttatttttgttaattttcttgtttttcattcaataactattaacacaaaactggtttagaataaggttcattggcagtttggcacccatttgccaaggttattatgtttgttattttgtgatagttgaagagaataatatagggtcattctttttacctgcaggggcagctgtttcagcaaaccactgcaagaaaatggaaggatctctcaatggaacattacaagacagccacaaagtagaaacacaaaattcgagagaagataaggaggtggttgttgaagttgatgattcccaagttggtgatatttccatcactgatgaagaggcaccaccaaatgaggagaataaggagctggttgactcaggcaaagttgaagtgacacaagattctgaatcagtttgtgagacttttgagcctgatgctgtgaaagatggtcaagttgagaatacaatggaatcagatacaatagagttgaaattgaaggaagaggaagggaaagattttctatctgacctagctgtggttaatgatgaggtgaaggaaacggatttgccttcttcagagagaaataatgagctcttttcagtttcaggaaatgagggacagagagaaaccgaagttgtggttgaaacatttaagcacatgatgtttggtggagaggagaagaatgttttgtcttcagttgtgacagataagttgcttagagagagtgaggaaccaaatgaagtctacggtgattcttctttgcctctaactgatgtgacttcagaggaaactgtggagacaagtgttctaaaatcagatgagagtgaccaggttgctccaaccataattgagaaatcattggattttgagccaacattggatgagaaaattgaggaaccatcaggtggccaagaagagtcatcctatgaaagtgccaaggagtcttttcaaccatcaccaagtgttcctgatgctgaaagcactgaaaatccggtgggtgattcacactttatgatagtttcatatagacatttcagtttgtgctaagcaagtgttggttgtaaggtttgcctttgtaattttatatgcatttatggatgtagtgatcatactctttttgttgtgacagaccattgttcctgtggctcaaagggaaaacacctcttggaagagttgctgcggactctttgagattatgagtggtggtgatagataagtcaaggtgagtaaacctcaaccaaggattattctttctttgaccaataataaatgataaataactgattaatcaaatatttgaaagggctaatatgaaacttaattcagctcatgaaagtgacttattttctttgtacaaatggtatatagcttaattatgataggatattatttgggtctgaagtagtattaagtgtcactataataacatctaaacctaatggaaatatttcacggtttgacttggagaccctgggcatacaaattatacattttccttattttaagactttgcgtaacccactaaagagaatagtctagttggcatcagaatctttttattgctttttgtcttgttaagtttgaaacaaaaaaaaagtatgatatggaaataacaacgctttagagctgttgtgctttctcaaacaaaattttacaactccctttcaaactgtcggtaaaacaagggttaaaattgcttcgatttaagtatcagaaaattgttttgattaccttagctgcaaaatatgacgttaattagtggcttttcaaattatttggacattgcaaggagaatgataagctgctatgcaaataaaaacttgatgcgaagcagcctcaattgtcagtgttgaacagaagtacgagtccaactgtgtatcaattaccgacatattagtaatgaaagtaactcctctaaacaagaaaagaattgaaaatatttgcctgaaattttatcatgcttactgatgaatggtgatgaatacaatctagcatgcattttatgtcaatatggttacattggtggttatcacttataacttataacttttgactgaatgcattgagggtggaaactctaaaataattttatactattattcaattacaaatcatcatatataataatttattaattttataataatttttaaaatattacattaataataatttatgattaattaataattttataccgatactacgtagtaattaaacatatatttttatttggccaagacttcggttctgaaatctttagtgaccacagacaaattcaatagtactttaggtgcaatttggcagcattgtagtaatgtggtttattgatttcaacaataatttcaagggatattgatatatgcgttataatcactgatgctcctcaagagtcaaaagcccaagtcatgtcaaatttctaaatactgagatgatattttaagaaaggatctattaaaatattggttaaaaattaaaataagaaattatttattatataaataatagaaaaacataaaaaaaaatataaataacataatttttcatttttaataaaaaaaattattttaaattacttaactaatgtccttaatacagtactttagcatttgtctttaagaaaacacttgtagtaaaactgattcgatcttcttgacctgaagattatcaacagtcaaatttaagaatctgatcatctgtcaaaattaattagctttgctttggggcaattttctaagttgtgaatcgttatttgattttttaatattatagggcagagcatcgtagaaggttgaaccttgagctaaggttactgaggcattgcataatcataggctgtgagggtgccctttcagacaaaatctttcctgcgtgcattcattgagcctcaaattaaggggcatgttctggttgctttcctgcttcgtttcagaatcagagtggttacattgtttcatttcaaaaatgacaaaatgtatggtatggtacattttagttgtggcatattgtaaacttccatgaactagaatttattatcaaaagttattttacattcaccacgttattatgatctatacgaagtaagctcatgtgtcatttcattcttcttctgtatagagatagaaatgccttttatcatagtttatcaaaaaaaaaaatgtcttttatcataaaggccaagggctaaacaaatgaactacaaaaaccaaagaaaaagggccattgctttgaaatgatacattcaaaggatgatttaagctgtcccatgtttggttgacgatcagcacattccattaatgatggttgagagaggaagggaatgtttggagcatgactatctaagaaacacaaatacttgtagaaattgttattcttaactccttttttataaacactaatagtattttagggtattggttaaaaaaaattaaaaaaaaattattaaaatacataaaattacgttattcatgacttttttactttctcatgttttattctctttaatccctccataacctaaactcttttaaacttctttcccctacttcccaacacctcattcctctccttctcaaactcttttgctcttgcacaattctgtcacacttgtccttcttctccattccccacttcctatccctttcactcgagctttagggtaagtttttttttaatggcatatgtaatggaagcatatttccgttatgtatctcaactagatacacaacaaaaatataacctataaggtttgatcatagctttagaaatggaacatagcccatactgtaatagctttgaagttgtaacaaactttgctattaaatttggtcaaatagttaattagttagatgttgaaaaattaatttttatagctagaaacttttaactgattgttatgctattattgaattaaaaattattagtaaaattagctgtcaaatgatatgcttaaacactataagtttttagtgtgtgaaatgcttagaaaaatctatctatttctcctctccaataaacaacaaaattgaaaattttatcttgtttctctctttattttcttccctattgtcagccatctaaacgaagtgcaagtgaaaggttctcttcctgataagatctatccttgccaggtgttgggcccaaaaattaaaggctgacactgcgtagctacaacgctttatgcttaccacacagtcttacaaatccaaagctgaaaattaaggataatttatttttaaatgaaagctgatgcactctgattttataaaagtgacactggtaatgagtaatgaccatacaaaatagatgccatactatatgtgtgctcggcaaaagctatttctacctgaatatcatgcaacttagatgctaatttttctttttttattcttttgggaaattgactttttagttcgccttgaaaaaaatcaatttcattttatatttaagcaagttattatgtagtaacaaaaaagtttaagccagttattacttgattgagccttcacctttaattttaaacaagataaaacgtaagctctttaaagcaggaactatttttctaaccgataataaatcattttgttgaatttggtgttcatttttatagggcagggaatcataaaggattgcagctcgcgccgggttcttccaatattgtaccatagttgagatttttacacatcagaatcaaattaaagattaaggggattttatataaacagactttcttcgcgtataaacaacattaacgcattaagtggattcgatgataataaaaattgaagttggaaaaccacaaaaaattctttgtgcctcactgaagaaaagaaagaaaaattccaacaaaaatgctacagcttcacgaaatttcgcctcctaagcagttaaacaatagcttagtatctatcaagttatgtcagcaatagcttagtaatagtaactatccaacgttagcatagcaatcgacactacttgtttgacaattgatcttcaaattcacgaaatagacccttgtgtctatttaaattaaagcaaaaggttaatagtactagtcaacttaacagaaactattaaaaggtggaaagaaagggatgcaatgcaagccaacgctttcaaactccaaacccaccacctacaactacaactgaaaaaaaattcaaccaaatacaaattcttctgaatacaattacgacagatgggatataagcatgggaagaaaaaatgaacaagacccgaaaaaacatctctctctgaccacattgcaagacaaaaagtcaataacaacaacaataaatcagtgatatcatctaatcctgaaacatcaattaattcagcaggtgggttctatattcaaagccatgctgtgaaaatgaacatggatgcagaaatcaactttagaaacagaatagcttgacaagaggtgataccaagtgccgccttaaactaacagcagtgccattgtttatcctccaagctaacaagggtcaaactaaacacaaagaaacaagtaatctcaattttgcaacctatttattaaatccaacacacaatggtttgatcctcataataagcaactaacaaccaaaaaagaagtatgccaacttcgacatgagcaaaaaattaacaggcttcaaaaacaaaagccagagaagaagcattattttgtaacaaacaaaattgcagcagcatagctatgactactaaagacctggtaagtctaacctctagaacctcctccagttcaaaatcccctcgctccttgatcactctccgatgagacagaaaatcacctccgttttccatagcacacgtagattacagcagcagctgcaacaatagctcctgtagaccctgctgccaccactggccactgcaacttcaatcccttcccttcaccgtgtacactgtttaaacctctatcgattgactcaacggtctccaccgccttctcattcagcgatatgatcaccctctcagcttcctttgcttccttgcgcaattgaagaatactcaattccagaccagtcactttctcctcagattctctaagtgcctcctccaacctcaatttatgcttaaccgactcatccaattcagtttttttctctgcagcaaccttctccaattcctcaaccttctgtctgtaacccttaatttccctctccttttcatcaatcttatccctgatctcctcctcaaatctaatcctcttgttcctttcctcaatttccttagtctccaaaactccaattttcctctccaaatccctaaccctaacctcactctcagccttcaccttcttcaatcctgccaattccttttccagagactcaaccctagactctttctcccccaaaaccttcctcaattcggcggcatccgccctcgcctcctccgccgcagtcatttctgataccatatcgtggtgcagcctcgccacctccgtctccaggtccgccgccctcgcggcgataacctccgtcgctttcgcagcatcacgcgactgtgccacttctctctgcagctcttcgatcttctcgcttttatctgcaccgtcgctcctcaatccgtcgagctccgccgtcagcttcttgatctcctccttcctcgccacgttttcgctcaccaattcgtcgcgctcgcgttgcaacgccacgatcttagtcgccgattcctcgccgtactgatcgtcaacgccgccgccgttggcaacaccttcgtccgccatggttgattctgccaaacaacgaaaaaacgcaaacaccgaaagcggttaattaagccagaaatcgaaatcgaattgcaccgcggaaaataaaataaacaaaaaatgaaaatggattgtaattataagctcgaagtagctgattaacggtccgtgaatcaaattatacacggaagtaaacaaaaaaaaaaatgaataaataattgttgaggtacattcttatgaagcaaaagcaaagagcaagagtaaggtaaggatagtacagagtgagagaaggtgtgaagagtgtgcggttgtgtcagcgagaaaacggaagataaattttccaggaaaaatggggaggattttccgggaaagtgacaaagttttatgaaatgggtgtaactagggttttgagtggtgtagtgtgcgtcaaaaatatcttgaaaactttaccattttcgttttgaccttttccttcacaaaaggaagtgctcagaaagtgcgatcagaatcaaccgacggttcagatttgaaattatgttctccgtgatgtgtgcgccagacgccagcatgtcaaattcgatcgggtaattccattttcattttttatgttcggatttgaaaacacttccaaattccaacacagatatttagcataagaatgttacaccatttttttatatatgtcatgtatcaatcaataatcaataataaataaataaaactaaaaacaacttataatgggtgcaccttgagattgtagagaatgacctcaatttgatttctacataatagtatatctttaaagaatacaagattaagctcgttaaaacagtcaaacaaaaagaaaacatacaagggaatcattaaaagaaaatcatataattatatatatataaagaggaagaaatcaaattattaattacttcatatattattatactaatagcatacacaatatctcacattttaaaatatcatgatataaatagacatacaaaacaaagtaacaattatcaatcatgcaatatatgcaaacttaactcgatagagattgttaataacttgggcaatcaaccacacatgtttcttaaacataatacaataacaatcaccacccataaggtaagaaggtaaagcatgcctaaaatcatttgggtagattaattgtatcaatttagagattgaaatttgcatttctttgccaatatctctcaactaatatttgtaacaagattagcgccttgaaccctcttttaagttcaaatacttgttaaaggttagcttacaaagggacaaatgacatgcaactcacaatagccactgctttttctttttttttttttccccaaatgatcattagttgaaaatgtccaaagacacttacaagagtatatataggatgctaaagaagtgtacaacaaatatacgttagcaaatcaaacacgctcaaagctcaatagataaacatattagtaaactatgaacacaataaaacatgcatgataatcacatcctcccattacaaacaaaccttaatagagtctaagattttctacgcttatttcttttgttttgttatttcttatataacgacacttgtccaacaacaattcaaactgagttggcccaaaataagtcataactaacctgattaaagtagtgttctgtagaagacctcaaaaaacaacaaatttgagtagggaagtgttgcctaagtaactttagtttggatacaattgcaaaagatggtagtaacaagtttagttgaaaggaagaaatgtgatgggggaaaaatagagtcaaaagagaaggttacatagagaaacacataaggctttgtttgggagagagattttggagggaaagggagggaagggaaaggtttagattgtgtcatctccttgtttgagagttttaatttttgaggaaaaggatttgaggatttttaaaactcctccaaaatcctccaaagcttaaaaattgttgttcccccaatttggggggtttttagaaggaaaagtaattaaaattattattataccccaactacaaatttcaaaatatattaaaatatatttttacatttaaattatataattttcatatttaatatcttattaactctcaatttccctctcttaatatatttttaactcccaaacaaggaggaatgaacttccctcattttcctctttttccttcccctcccttcctcttgaatctctttcctttccttcccctcctaactcccaaacaaagcctaaagtaaaaaataaaggagatgaaagtgatggctagaaaaagaatgggagaaaggttaggtgaaggtggtggccagaagagaagaaatgtgatcaatgacagagtttgacaaattatttcaacgggaccaaagtagtaaatgatagttatactcaatactaagaactatagaattctatttcaaaagacaataataaaaatcactaagaactatatcaatcaatatactatagagtcacattaagacatgagagtaaaaaaaattctaaagaaatttaactatttaagagaagaaaattttctcatatctaataggagttattgagataaaaaaaaaaaaaaaaaatccactaaaccttaagagggagctgagacaccactctaagtggagaaagggccacaaacatttgaagggagagtttaagttttgtctagagatcatgtaacaagattgtaggtgtaagtaagtatgaggtaactacgataaatcaatttatgtgatcttttcttattttcttgtagtattttctttttaatacatcttactatatattaatatagacttgcaatatttgttcaaacggttaaatttttgttcgagaataactatattacgaaattaaaaaaaaaaagacaataataactatatacaggagtaattctaacgtttgaaatttttgtgtgctaataaatggaaattttttagttaattttttaattttaataaatattatttatatcattttaaatattttttagatttttacttgtattgtatttgaatttataaatatttatgccatataagaaaactaattctaatataaaatagtaaatataaattggacttattcctctacttctgcgactatttcatccccaacccaagaggtctcgagtatccactgcaggttatccaacatatattgagtgcatccaaggaatggttttatatttattgcaacctatcacgtaagattttttattaaaaaaaatgggggcttcagccctccttagtaaccaaaacaaaaattatttgtcttgttttttaacctcattctccatcatttttgttaaaaacttaaaatgatgtatcacttgatttttaaaaaattaatgtttctcttttaattattattttttacctgataatttttctatacattcaacaggagtactgtttgtatttaaagcataaataattaatgcttaagtttattatattttataatcaaatttaatttttaaatacaaaattacataagaatgtgttagtaattgatatattgataatataaaattttttatattattatttaattaaaaattaccgttaacatgattttggtattacaagtctactctgtcgatgaagtggcactaacatcatataagaagagatgtgtgtaaatttctcccctgcctgccaattcctttgaattgtacatgagcaaagctttataatgttgtttcatcagtgaatgtggcgttacaatactggtggaggttattatatatatatgcactctttggagataaatttggtggttatgtagatcagtaatagtcagccacctagaagttagataactcatacatgttgtcaatgttgaatgttgatgctgcatgcatgctttatgtgctatgatggatacatattgttgttgttcacaatgtcacacgcccaagttaatttctgcctacgtgataagcttttttatgattcggtctcaaaaaaattgtggtggctggggctgtgattgtgactgtgactgttccaggatgtttgcaattggagaatgcagatgggttgtttcagcaaaagcatgctggaatttgattgccagagtgtggtgttctgttggatctccaaaatagtgactgtagtgggagtgcctttgctgtagtaggtcaaaacgattatttaggtttttttttagttaaataatattggagatttattttgaattattatcgaaaaatgaataagttgtaacatttattacgacttttgaattcaaagccacatacgatattactatttctattttttttaattaaagttgtacaatattttatgacttaaaaaaatttattccttcgactttaaagtcgtattaaaaaaaaaatagaagtcataatatcgattacaactttcaattcaaaagtcataaaaaatgttacgacttattcattttttgataataattcaaaacaaacctccaaatgataattaactaaaaaaatatccctaaatggtcatttcatcggtgtaatagtagtcatgagagtcttggttttatctcattatatcttcagtcctatttatgaaaaataagtgataatatattttatattatcacttatttcgtatgaataagattaaaggtagtatttattactatgcccacaattttttacatgcatttctttcatttttaataaaatttatgtatttaaacatagaaattttgacattatatatgatactatatatgtacaatatattctaaaattagaggaaacaactttttgtgttgtatcaattttactgattgaatacatttttttcttttttaagcagtgattgttaactttgaaagaaagtgagctgcttttcctaccactaaaaatgcaagcaaacatattaaagttagtgactcttgttgttatttgtaagctatgttccatctttgaaatacatgcacagggtaagaatcaagaaggttaagagtgatgcatctccaacaaattaatggctgtactatgattcggctaacactatcatcgccaatgtgttcctttttaccttaaattatggaagatcatgttatcctcggatgagaaagaagccatgtgaaatttacaacccttcaagtgggagaggtgctgtcttttttctttctgtaaaccgcattctaagtctaagttatcgtggtagtaatggctaactgccaaaaaagtcaaacaaccctattccaaaatctccaaagcaaagttttcacaacaaaataagaaagaaagtgaccaatgacaacatgtgtatgtgccatgttactttataaaacgtctgatctcatccagatttcatgacccaataggggtggcccactggaccaagatgaactaaaaatgaaccctgtcacagcccacgtacatcgaagccacaccataatgtgtcatacacttgcatctactctaactttactccactccagatcatgaaacaggttaataagattcctacaacagttgcctaaagtcaataactccttctgtaacattaatctgcggcgtatgaatatatcaactttcaagaagatatatagataaagtcatggaaaaaaaataacactgtgaaaaagaaagaaagagctgatgagaacttcaaaataaaaaattaaaaaattaaaaatctaagaacatcgatcatgggataaacattttccttgatcccaacttccaaaagtacatcaaagtaaaacataaaaattaaaagaagaaaaataaaaattctaactaatggggtctgtgggaaaaaccaaaaggacctaacctaagctgcttgcttgcttccataatccatcatcatcaccatggattattcattcattcattcatcatctcatgttgatgttcaccatcaacctccaaactttgtcttctccttctccaacttttcaaagaaaccagtgagagccctcaaggctttgacttggtactgcaaagcaagaatatagccagcagtttcatcaaagagcttgtccacacctaaagactcaccaccaggcacaatcctctgtaatgcatgaatcttcctctctatatcttctctgtcatcaccctcatcttctccttcttctttttcttcatcttcttctttcacagcatctttcactgccacttccttcctccaccgcctcctgctgcggcggaaaacatgcaaagacttgtgagaaggggtgggagagttgtcgttgttctgatcttctgcaggttttctgaggaatgtgggtatgatagtgttatcttcttgttccatggatgatggtgatgacatgtagttgtagtactaatttgatgtgtgtgtgtgtgtgtgtgtgtgagagagagagagagagagaagggagattaatgtgtgagggagttatatgaggtgtgattgtcttgtgtgcgaaggagggagggaaggaggaagatgttaaattattgttgagctctagaaatgtcaatgccaacgaagctggtcccactggttttggcctcacaacacaaagaagaagaagaagaagaagaagtccccaagttttggattggagcgatgaggtggccttcacgctccacatcaacacccctcatcaatttttttaccctcccccttctaaatttgtttatctttgtcaagttatttttctactttcttatcttgtcacgaatagttttatatgataaatttgtttatttttataataaattcaaaatttataatgattttgtctttataataaacaaaatctaaatgcaatatcataaatactgttgatgttgttttttttttatcaacttagagtttaatttcgataatgtgcataataaagaattttattaaatattactttgatttaccgaaagaaaaacttaaacgaacccgcatctaaattttatctaatgcataatcctttgttacaagaattatagaagtgaaactttaattttgattataaaaaaagcaaataacacttatagatttgtatctaaattttatctttataataattattttagaagttatattaaaaatgtttttaataaggttatagtataaaaattttataataaaattaaagtattatgttaccttttcattgcttattatttccttccttggaggttgggataaaaatatcatagttttctaataattattgataaaaatatgttaaactaattttttttaaggaatcaaacaattagtatttccatagattttagagggtgttgcaagatcacaggaaagtggcatcttagatgcactaaagggatatttatgatcaattatagcatgctaaacacatgcatcttgttaatagtgtataaaatatgtatgggcattagattttaaggattcttaagtagtaagattcaaaagaggattttggagagaggggtaaaggtgaaagtataaagtttagaagtgactgcaaaatgcaaccccgttaaggagcataaaaaatggtcccacagaacacaaaagaaaggggagaaagcacatgtgctcacatgaattccttgaacttaacacccacccatgtgcctctccactctcttctctttcattcatatgccatgtgatctccatcactacccttcgcatgactgccacgtgtttactttccaatgaccccaccttgagccccacaaaaccccccccttctaacccttttaggccaaattaatcatgtaaattgctagaatcatatcaatcccaaccctattcaactaacaacttgggattttaaggaaatcaaatactccttgcttagcttatttaggacaagttggttttctggataaagaagttaagttcgcatttaagtggctttttcgtatcaaaatacgccactcccttaattaaagagaaacatgactacaatatgtttattaaatgatttattatgtcgtatccacaataataaatgcctgtaaaaaaaattcaataatctgaaatgaaaggtatcaactgccttgaatggttttcaataaaaaaaaatgttgcacagataataaatttaacagaacacacaaaaatagaaagacgttctttattacattcttttgaacactttttttaattaattaaaatttattaaaaatatttagattttgtgagtctcatactatatttaattattatttttctaattttatagtttttaataattttataataattaaagaggatgtgtgttaagaacatgttcttaaaaacaaaaattattgatcgtgagtaaaaattaaaaaaaacacataaataaaaggacgaaaaaattgaacgtgatgaaagcttgagatatttgtaagaaagtaaattatactaactatttttcaccaaaatgagagagagagagagagagagagagaaagaaagaatacaatttttttatagccgtttattatttatatttaagttatataattaagaaacaggtaaacggttatacattgaaaatgtaaaaatatttacacaataattcaatcataatttataatatataataaatttattaactttaaaataattatctgaaagtaatttaaataataatatatcattatatgaaattataaaattattttataatatcattatataagcattcaattcattaagaaatactggtaagaataaattatacacaacattataagataaaaatggtagattaaaaatttgacaaagtagatggtgttgtaagtgtgatgatactcataaagagagtgaaaagatgattgatgcatatatatatatatatatatatatatatatatatatgtttgttaatttggtagtgatttgggttgcagctttggtgatggtgagcgtaattagtgagtgtggtggagaatgagagaggggaggtggtggtgtttccaagaaggaaaccaatcggcggattgggtcattgggattgtatgagagatttggttgtgttgggcatatgggactccatgtgctcagacccactcggatccctctgttcttgtcacattcacacactacactacccttttttttcaatccttcgtaattctttttcctttttttaattttgttctggagggtaatggggtccgtaccaccatttcttgtacgaaaattgaaatcaatttgttacataggggccttgctttgcttggcacatatatcattgatgagagagctattataattcaatctcatacatctaatctaactgcaactgtgtcgacatcctacctgagttttgtttctgttcacaatcttttaacagacctttggacttattaacatctccaaaatcatcttacggtgcaaacaaatgaagctctcacatggtaggcctctagggatatacctattggcatgtttccattatttcccctcctagtaggtcacgaggacatagatatataaaacataaaaaaaaaatacacataataaatgtttaacatgtttaatcatgaatattaaataacacttaacttttctctaatcacatttatttttgttagaaacaatcttacttaaagaatcgttggtcagatagtaaacatgaaaacttaaactttgattcgtcacattataagatactaatccttctctatagacctaacccatgctgataacatttgacttatttaagcatattgtgaatgatgataaccaaacattgaattaatcatctttaattaaagaaaattctatgaatataaatgaactaggcatgcatgatggcaccacaaaggttcaaacaaggaaagggaagttttagcatccatttttaggatgcgtaggtaaatggaaaaaaaaaaatcactggagcaaaacttattgcaacaatatcagcaattaggtttagaaaagggaaaaggaaaaataaatgcatgcagctggtgaggaatattcacagttggtcttgtagagagggaggaatgagaatttttctcaacctgataataacttaatgatcagcacatgaactgactcagacttttattggtgagccccgcgtgttctgcagcttacatatgcagtaaatgccaaacaataaacaagcgaccagatcattcaaatgcattatctcaatttcggatttacctcattttctaggtcattctttttaatgtttttaatgtacgacattaaattaatgattaatgtaaatcaacaaacaatgttacagtacattttagagccaagcatctagtggctctttttttcctcctttttttttattatcttcaattctattatgtgggctgcaaattgcaatgcaacattattctgacaagactgttccaccaggttttctgatagattagtaacaacctaaacaagtctctttgcatcacacattccaccattagcattttaactattctgaagtaagaagtagaaaaaagcaagagttacaacttacaagtggttgtacattctgaaagcaagcctccacataaagttaatcttatcctgtatagctaggtattagatagagcttccaaaaggtagctgcagtaacttcctccacatggaaggccaatgtggctccatgaggggagaaggtgggcacatgtccgttcaaattttcaaaatcatatgaaatactgtgatgtcgtattcgatccaatgctcaaactatttgtttggggtttgattccaataaaacaacgaggtgtctatttttcttctttcaaaaaaaaaaaaacataaatagaaggaaattatgcaagcaccaaacctactttcaaggataaattgttactgtgcctaggtgaggaaaatttggtagcatttgaaccatttgatataattttaaatggaatccagttgttaaagaaacttgtgaggaatctgtttctataatggccaaagggggttaaaacactatggttaaacaatgaaactcctttgcgtccagtgtgtataacacgcataaaacactttacattttccacatttttactcgtatagtagtacatgtaccggtctgatttatttatttctacttggaaaatagttattgcaggaaattttaaaaaaaaaaatatatatcctgagcaaaggaatgtgtggattgaattacaagataggactcaaattcggttgtacagtttattgataactgaaaccaatgtttacaaggtttgaccagagaaagctggctctttctggggaagcactaactcatgtcatcgtcatcgtcttacacaaagcaccaccagagactactacttctccactatgaagaaccttttcttaatctccacaaggatggctccacctggccaaactatttacaagacaacattcttctagaacaaccttgtcatgccatactgaacaggtccaacctttctatgagcagtggtactaatcccaccatattgatgagcctttgactgcagcaacttcgtttcaatggctattcggtcatccttctctatcttgttcactcctgctcgtgtcatgaaaaaagggttggtgtcaatatttatagctatgtctggtgctattttggcattcacaccacattgctgagcaagttttgattgtaaagacaccttgtcagcttctgttgctgacctttcttgttttccagaggttgatctttgataatgattcgtagggggcataggttgagaaggaagaacagaacctctcataaatgtccttggatcatatgtacccttgacaacacttgcatattcgtatggaatcactggcccaacaacttttccaggttttgctaaacacaagaatgttagcttattgatgactaataatgcatacaaacttaacaaaggcatgatgataattgataacagtcacataccttgtggaaatttttgcagaccctgaatagaccttggcgcaggactttctgtatccctggaattattattattttcctcagttgtttgccggtttatgcaggaagcaatgtttgattgctctttcgagggtactatatttgaatgtacaattgttgacctgtcaatgattccaaaaaagagaaagcaaacaaacaaaagttcagtatgatgtaatctgattaggctccctatgaatgaaacagttgtaacagcaaatgcagcctggagaagatgtggattattttggtcgatttgatctcatgccatgctgagacattcaaagagcagataaataggatggtgggattcgtatatatattttacagaaacgtgaaattaaagtaggagattaagtggcggggagacatggaaatgaaggtatcgtttcaaaaaatttgtctagacaggatatgccttatttgcaagatggaaaacccgttgatatggtcttcaatccactaggggtaccttcacgaatgaatgtaggacaaatatttgaatgctcgctcgggttagcaggaggtatgaattaagaaaaagggcacatagaaagtaattagcagcaatataaaccatggctcaaataaatatcaacagcgggtttgaagtgaagggtatatgcaacccttagacttcactactactgatccacgtctctagtcgatgtaagatctcaacatttgactacaaggtgtaaacaccactttgatactgtattatgctatgtaaaaactgttggaaagtcaccttaattgcggtcatccttgacctgccttaattgcggcttctctgagctgtgccttagttgcaacctctttgggctgccttaattgcagctttgagggggtttatttagtatcgactagagatatgatgttaatataggttatgaagtttggataatcctcaccttacaagtgagttttgtgggattgagttatgcctagtgttgttcatgatttggttattcaagtaaccataaccataactactaaataaccagattacaagttgttatcataaccataaccataaccataaccaattttgtacaacctgttatgatttgatataaccggttattgttttaaaaaaccagttatatctaatgaagagatatcttaaatataatataatcaaagtaacctattgttaacaacccatgattacaaccaatgacaagtgaaacaatgagatacctacattagtgaattacctgggaagtgatgcatgctttctttcaggtggcataataggacaacttttaccactattttcctcgagatgagcaaactgctgtttgaactgatcaacagcactgtgaagaatatgcaccaatgaagggtaaggagagaataatagggtagaacatatgaataaaaaatattaaggaaaagaagataaacagttgaagtataaatcaataaaccaaaaataaaaaccttgggtaaagaaaattagttctctctgttccatttatgtagtctttcaatagttgaggatggtactctagaatctcacggaaaattaactctccaatttcttcctttgtgactcttctcctttcgaattcaaactccatttttgtaataggctggcaggatggttccctctcaatctttgaaagtcccttgaaataaggatcagctaatgcctgaaaatgtcaaatccttcagaattctaaagcaaggaattcacatattgttgcacatcaattatacatttctattgtccaaactccaaagaaaaagcataagctcaagaagcagttaattatctgagtagaataatgtttcaacacacacacacatacataagaaatagcgaacaatataaaaacctcttcagcagtaggccggtcttttggatcaaaggcgagcaacctttccagtagtcgtagtgctaaagggtctgcattaggaaatttttgtgcaaatggtataggctgttttttcctcatactagttaggtatctccgtgccttatcattgcgtacctgcatccaacacaaagattcaaaattgtaaaccagccaaacaatgatgttagtaaaacttagttaagaaaatacaaacagttttccctctagagagaaaaaaagaaactaccttggatatagtatccagcgagggagtgccaagcaaatctgtcatcagatccaactgatggacaacatgttttccagggaaaagaggctttcctattaatacttcagcaaagatgcaacctatactccaaatgtcaattgctggagtatactgcagtcaataccttaccgttagctcatcagcagacacaaaataaaactaatacaaacagaaaaccagtggattaagaataaataacagattggtcttgggtcttacttttagctattgatgggaaagaagataacagaaagcatgtatcatgggttgatatacaatttctacacacaaaactaatgagcatgaattaggtatggtgtgagtcaagattatgcataattaggttctctaccacttatatgatgtctgaaaatcttgaaaaagccatacccttgagtaaaatgatccacagagttctggtgctctataccaccttgtagcaacataatcctatagaaaagtattaagtaagcaagaaaacatcagcccctatgttaccaatacttttgatatgagggagcaaaaaatctagcaaagctgttgaaaaggtatgaaacaaacagagaaaatgttgggatggaataccgtccaaaacacagttgttggtgtgtcattgaaagcaactctagctaacccaaaatcacatattttaagtttacagtttgcattggccagtatattctttggcttcaagtctcgatgatagacatttgctgcaatgtgttgaaatgtaattggtgagcaatattgacattgatgccagcaaccttatgttgataaatagacaaagtaaaatataaaaaggacaaatgaataagtaaaacattttggcaaaaccataaaaatactatacaagtttaaggagatccaggaatgaggtgcaaaaaaaagtcaacaacagcaatagttagagaaaaaaatatagatgatccagacatctttgtaagaaaaatgctaaggaattacacaatttcaattacatgtcattgtagagagaaaacaagctatagccactagcaacacaatgcgcattcaaagaagatattcatgaacaagtaactatcaaatattgaagaataccagagtgaatatacttcaatgctcgaagtaactggtaaagaaaaaattgatagtgctcttttgttaggtcatcattggctttaatgacttgatgcagatcagactccatgagctcaaaaacaacataaatatctttaaagtccctcctagaaggaggcagcataacatgcttaatttcaacaatatcaggatgtcgaagaagtctaagcaactttatctcacgcagaatacgtgcagcatcagatacatgctcaaagatatcatgaatctttttaattgctactttttcgccagtatgagtgtcgatagctgaacaaacaacaccatagcttccttttccaatgacctcttgaattttgtacctgctgacattgccatagtcggagaaaaattccatttccattgagccctgtaccaaagatattaaagtaatccgcaaaggaaaatcaggcaagcccaaatttgattgtctacaaatgttaataaatcaagctaaagcaccaattgggaaacaaattttcataattgataaatagaaattaaaagtaataaataatttttctttgctatgttacaagggaaattaatttatatctcggaatccatgatccatccataagcttaatacacacaacacaaaatttgtgtgtgcaatagaatttacattatgaaactcagtattgaagaatcatagaatcaaagaaagagagtagaaattatatttgcagtaatctgatcatgtctgcatagattggattaacacaagaaaaataacaaataataaacataaagaaacacattgtcaccatacaacgcttcactccccagcttaacaaagccaaaagaaggggaaaatacagcacttaaaaccactcaacacatcacaattcttatgacaaaccaatattcattttaagacgaatattttttttcttcgccaaatcatcatttcttgtcattcaccaacgtttatttcggagagtcaatctcgtacaacgcacctaaagcgtgcaagacacatctcagaatacgtagaaacaaagaaaagcaaaagggtgggttgattgggatggaagatcaacctaggaatgccatctaaccagttcaaagaagcatcatgcaaatttcatcaacacattagacccccccaaaaaatggtgaaaaaaataaagatcttgtcaaccaaatgtcacgtgggggaaataaattatgtcacgtgatggattaaacattaggagagagctaactaacatcataacacagccccatggaaccaacttaacagaacctcactcccacactttgacttatgtaatctaaaattctcggtagcaagtagtaacccaccaacactaaacaagacaagattttatttttataattcattcggttaaactcagcttagtcccaaaaagggcaccttcataattcattcgggacagagaaaaacttgaaaaagtaatgatttgtatagcaattaattagagtaatgcttggaaatgaggagaacaaacaacaaattcaccttttttctttgatcttgctgcattctgaggcaacagctactccaaattaagccaccaatacgaaacagaagaaattcatagaaaggtaagtttcaattttggcataaaagaaaactcaagcacatttgccccacctaccccagctccttcaacaaacacagaatccaaataaagccccaccttcaatcccaacaccaaactgctaccgcccctcaatcatgaaatgacatagctctaacttagtgacaaaaactcactaatccgtaatccctctctcacacacccaccatagtgatcccagtgaagcttcttccaccaaaagcgcgtttgaagttggagctgaagaagcaaaaaacgaatgccccagaagaagagcacaccgacacagggagaaggagtgaaaaactatgaaagtttctgttgttggagccttgaaagaatgagttgttgtttattgtaagaaagggtggctcttctctctctctctctctctctctctctctctctctctgcttcgcgttcgcttgtgagatacggatttgggattcttattataccgaaggggcgtatttggtattttgagaaagtgtggagggtggtttcgtgatttcaggttccgaaagacaagtgacgaagtaaggtggcagatactgttgtggaattacctgtctgtcccctctccaacttacatggcacagggaatgtaccaaacacgtgtcaggtttaacctttcaacatactacgatattttttaaatttcaaattttcaatatagcattttttttttttaaattctataacatttatcatcacttgttttaattattacgatgaaccatcatctagtttcttattaacatgaactttttttataaatttaatataaaataaatagtcatttatatccttaaatgtgtagaacgctcacaaatttatcctgaaaaatgaaaattcaaatttttatccttaaaagtgaaaaaagtgtgacaaatttaatcatccgttaacttttgtccgctaatgttgattcatagacaaatttgtcagctctttacccaaaatataatttaatcttcatattctcctttttttaataattacaaacataaaattataataaacacttataaattaaaaaagcaaacgtaagttaaaacaaacataataataagtataatattgattaataagtataatttgtttgttactctaaaatttctattgtaataacattagatatagataatgacaaaatcaagttggatcttatatttttaaggattaatttaatgattgtgcattttaatttgtttgaatctcatattttgggtaaggtactacctcatatttttgctttgaaatttctattgtgagagtactttacccaaaatatgatactcaaataaaatttgcacagtcgttatgtcattaatttcagaacttgattttgtcattatttaatgttgttataatagaaatttcagaacaacaaacaaattatgtttattaatcaatattatgtttattattatatttgttttaacttatatttgttttcctaatttttaagtatttattataattttatgcttgtaatgattaaaaaaggaaaaatatgaagattaaattatattttgggtagagaactgataaattcgtccttaaaagtgtagaacgctgacaaatccgtccttaaatgtgtcacgtagactctttcaattaacgataacggactaaagttaatggagtgataaatttgtcacaccttttctacttaagggacaaaaaattgaattttcatcttttagggacgaattgtcaacgctctacatattcaggaatgaaaataaatatttaccctttcatatattttataaaaattaatataatgattagattatttaattttgtatttttcataaaattattaagtcgtataagtgagatattcggtgtcatttatcctgagtcttatttcatgtatcaagttcattatgaatcccaaaaaaaattgttaaaaaattagaaagaaaaattaatatggttctttgtagaagaaaatcaataaatactttattttcaattttaaaagtaagaggcgtaattagctttaaaaactttaggaaactaaaattgtaaatatttcaaaaaaaatgaccaaataaataatccaaattagaaaaccaaaactatagttaaaactaaattataacttgtccacttgcttgcttatattatgatcctaaacttaagactatgtacttatactaggttagaattaaatttattcatcttataatattctataaattagctgaaattaaaagtataattatatgatttttatgattataattttttaaatatatcttgctagttattccaaatgtaaacaaaatgaaaattgtattgacaattattaactcttcgaaattatggaagtatattacaaagtgttaaaatcagtacaaaatacgtgattttatagtggttgtaactttgaatataaaacaaaggttaaagagtttgctgattggattctaattttaggtgatgaaaaattaagaactacgacgatggagaagctgatattaacatttcagaaagtttgttggtgaagaagtgagaaagttcaattgaggatttagtaaagtttactaatccaaatttgataaaaactccgcaaatattgattacttttaggttaaagcaatgttgactcctatattgagagtattaagttcaattaacaagtatgtcatatatatcattatttcctggtgatgagaaagtatatctcaattctgattcattatggaaattaagttgataaagatattgatattcaatctaattactaaacaactaaatttctaaataatatgaaatgctttggacttcgatcttgattacaactagttttggaaaaaatgtgttcttttgatgctcacgagaaatatgatttttttttttattgtctttgaaatgaaacaagacattttgttgaggaatttaggtgtaaatattattggtgttagtattgttagtgacaataacacgggccgtaaggtgtattttttgaagaatgaacttgtttcatttaattatatgactctgctcatgtttgattttgcaacgagttagaaaaaaaaaaaaaactcaattagtttcatgttgattgctaagcaaattggcattgctttggtattttcacatattttacacgctttttgaaagttcaccacaaaaccaaacatgttatctatttgaaattctaaagataacaattttcacttctagtatgtttcgttatgtctataaacaaaaattaagggtaaacgcattatcgtacattttagacattaaagaactaaatcaggattttttatttttcatatattaaattgtcaattgtttatatattgaggaataaaataattctttattcttttttagaacaaataaaccaatgttatatgatactagatgatgtaaaaataatctaattcaacgcatgtttttttttattttacggcattggttaaacacatgttaaaattcactgttattaattaatgtcagtgcaagttcacagggtgaccgaataatgtagattaaaagtacactttaaaggcttctacacaaaaataaataaatcacgtcacataggaagaatgtgactttgtttacacatatcccaagagattcattgagcatattaacataataaataaatcaaatcaagatgtttgttttatacaagtatatatcaattattgtcatctcttttttctgttccccgtatgatcctaaacctaagctgcattatatttgccgaaattgcatgacaaatacacatttcgtagtactaatagacttcgacctttcttttccgttacacttactctacttgcacaacaataccaaacatcctaattaaccgcaggatttatcaatacattcaacagagacaaagtgaatcgttttcaaaaatcaaaacaaggatatacgagattatctattcaatcagattataaaaaaaaaaaatctactcaacaaccaaatgatcgagattaatatataaaattagttctatttagtctgtcatctgctctctttaatctgtagctaaagttaatttcaacttatattttgtgtgtgtatataacatattggcatactgcttgctggaaattggaataagaagtgctttttaagcttcccaatcacaaaattttaacagtataaaccatagaaaaatagttgaagatgaaaattatttccaacaaaacagttgcattagtgtgtatacattttatcgttttatagaactgggcattattctgaaagtgtagtttgtttagataccgtgaatggaagcgaaaaactgtgcattatgctttcaattaatgtttcaaaattttttcaattaatgtttcaaaattgaccaaggatttaacatatactaacaaatttgtcgctattcaattttctgaacggccattattcaaaggtaaaatatatgatgaatttctgtgaaaaggaaatatttgaaatgaaaatataccatttaaacacgtctttttcttgtaataaaacattaatagtacaaacacaatgatatctttgaaatgaaaatataccattttataaatatgtctttttcttctaataagacattagtaatacaaacgcaagaatgatattctgtgatgaaacaattaacaatcatatatcatagaaatgaaaaaaaaaagttcaaaattatatatttaaatgatagtactaaaaaaaatattaataatatgtaaaaaaatatactgtacctataaaaaatgtactatatatatagcaaagtaaaaaagtacacaaaaatatcaaaatgatgagatggtatcgatcctcattaatgtcatgaacgttgtggccttgtgggcatcgtccattttaaggagtggtgactcagaagttggggaggatgtgtaggtgttccaatatggtctgcatcatctcactccgatttttagttttaattgaaaattttaaagagtaaatgatttatatgtaaaaaaaattatattatcatttaaacataaatcatgatatattataggtttattatttgtcacaattattatttataataattatcttaaaaattatactagcacctgaaaccatttcattgacattttttttagtattttatacgaaaattatactccaagcaaacataattttagttacatcattgagagttattaaaaataaaacattacatacttttctccttgatgtgataaggagtagcatttagtagcggaaatgtggaatacattattgatttgctcaactttaattcaatatctacatactttaatttgctgtaaattttagcaatattaaagtgaggagcagcatgagcatgcttacgcaacgtagcacgtgcaacgcgtgtttcacgttcacgctacgctatctggactcatgaaccaacacggtttcgtattgttgttttttctttttactagagcttctgactagtgccattaaaatactaagtaagaaattaataataaattttttcatttaaaatcatgttaagaatatattcgaaattatgttaagggtgtattaacaacacatttttaaataatttttaataatatttttagattattggttactatttgttcttttttatttactaaaatcaagaattatctgaaacagaaaggatcttctttttttgtataatgttaataaagttttctattttattttcttaaccagtttttgtatctgctagcattttcctaattaaattgttaatataatatagtttttcaaagtgtgtatttgtttttttttttttttgtataattctaatccaacgtatagacgatagtcacatttagccacaaaaaatgaaatggttaaaagtatatttgtttttattctggatttagttaaagtcattatattaggttgattcaacatcactaatttggatttgctagacctccacgtctattttttttttaaaagtttaataactataaacactaagtagaatataaacaattatttattataaaggagtttagttttaataagttatcggtacaaaaaaaaaataacattattaattaaaaattatcttagatataacttttaaaataattattataaaaaataatattatcatacatgacactgactagataataaacaaataaatatactattactatattttaattaaattcttataaaaaaagataaaataatcataagacctctcaaccttataatatataagtgatatataaaatgtgaaacatatatatgcatggtttactgtgagatactatagaaaaaacgtagtttgatggttgtcattgatgggtttttttaagctgtaaaaaaaatgatgtgttttttaattaaaaatgtatgacactattatattaatctctttgaaagtaagaaaaatttaaataagtttttaaatgtgcagttcgtcaatcacaatacagtccaaaacttaaaaaatgtaacgataatattaacaaataaataatagtaaatggttaagtttaaagatttataaaaaaaaaaaaaacttaaaatatcataaacttatattaaaaaataatgttaaaaactaagaggacaacgctataccaaaataatgtagtaatttactaaaaaagagtcatcataagaatatactaagctaggtgtttagatacatgaaaggttgtccacaacctccaatatggacattttatctgttctgaaacgtattgttggcgaatcagcaacccctctatatatatatctccatttcattcgtgtccctcttctcattcaattctagtttaaattaatgcaaacattgacttgtaaaaaacaaagaaaataatcaccaattcaggtttcaacgtatggttggaggttatgtgacgtaacaacaacagtaaaatagtataataaattgaagttgcatttcttatagacaacaaacgataacattcatcaagattttaataccctgcaccctctctcctattcttttaagaattttataattttattttcactaaaattagattgttctgctgaccgtgcaaactgcaaagtacgggtaaattattctgttaaatacataaataattaacggaaaaaaataggaaagagtacacttttcattcatgctgcaacttatgtgttgagaaggggataaatcgaaaagatttatatcaatataatgaatgaatttgataacatactttaattcaaaatcttaaaatttagatttatagattttatttttacttatacatgatattggactttatctcatatttattctccaacaacaactttattgtattgttgaatttgattttaaacaatcaagttttgtttttggtggtgctaattaagatttcatttataaattattcttgtgtattttttcaaatgtagattttcgagccataaatacgatctatttttattttcttaatatgtgaaatttcttgatttttcttcaatagtatatataaccaatagtcaatatatgacaaaaaagattcttgaattagccataaggggggacttacctggcctgttatatatcttgcctcaatcatgataaaatacgattgtgatgttgtaaagtgatgtggcccaatcatgataaaatacaaattttttggcattcgttcgtatatgtgacatcgttgcaatattcgttatgacttatgagtgatgaagtcaattaaataagtaatcaatgaatttatgttaaacgaaatctacataaataattgatttagtttagtaacaggttaattcaatttgtgttctacattcatatggactacggtgttacaacttttctttttgttgttataaatttgtgcttgaatttatatattttcatgttaacaaatatcatattatatagagagagaggagtatataatatggtaatttcatagcacattcaaaacccaccttgtcaagtaagaagccaacaaaacaaacataactatattatgatttcgtgttttaaaatcaaatttaaaaaaatgtaaagagtctaataaaaatattggttatattaaaagtttagtccttacacacttaatattatttttcattttagtcttgacatgaaaatttacattttaatcctcacatgaaaataagtgtttaattcatatgtattatctgtaaaaaaaagttattctatcaatcaattagaaatcattttttatatgatttataagataataattaaaagttaattaattatcaaattatcgtatatgatagtttataattaatcaatcgtgtaaaaattctttgaacggtcaatatatacactattaattctaaaaaaattacaaacttttcttaacattatctatactctataataataataaattaaatattctccatttgttatccacctttcatttcattagatagttttaaaccatttcttaaactttcatttttttcctaacctatagtaactctcctcattacttctatattgttagttttttgtttattctgtcacgtttttaattatttgtatttaacttttattttttaattatcatttaaaaaatttagagacactgtttccctagttataatagtgttagagtatttttcctataaagattaaatggaaaaagtgtgttaagtatacgaaccaaaatgttaacaaagaaaagtttaaaaaaaatattcaaaatgaagtgtaaattcattcacatagtgactaaaatgaaaaatagtaactataaggacaaaatctaatatcattgtaacacgagaaggaccatttactcatgtaaataataaaatgtggaatgttttcttgtgaaaatcaaaacaaaaaatgatgtcaggtctacgggcttaatttttaatttaacttaaaactaagtatttataaaaattaaaattaaaaagttaattgtattaaacatttcatgtagtttgttttaattcacgtcataataacacaaaaaaagacatgacatcttagatagttgttatttatttatttatttattatattttatgataattactttcgaggagaaaaaaaaaaacagaaacctaattttttattttattttttggaataaaaaaaccttaattttgagcatgaactttcaaataggtcatatttacataaaagacgatatttatacaatttttcttacctctcctgcaactatagttaaattttttctattggtgggattgatttcttccttttgtgacatcagaatacaatataaataagataagtctttctaattataaattcttttaacagataagttgaattttcatgaggtttgattaaccccatgactttttgtatatcttttttttttttaatgatatttctttgatttgtattttctttctatcctaattaatgataccaagttagttggaattacttgtttcagactgactcagtattcaagcccatctttattaaaaaaaaataaaaattagcatgaacgattgaggttgacataataatcataagcagccgaaaaaaaaattaacccttgggcgtaatgtacggattgttgtcttgagcacagggctgcatatttacatatttgacctttccctacgttttggtgtctaaatacaactaagtataatttactaatttagtggaagcaatacatgtagagtcgtatatgagtacagcttcgtggataacatgcaaaaagtttcatatggcttaaaaattgaagtcaataaaagtttataaatagccttctcataattcactgaaaaataaaatagtgatggatcactgaacactaaaacagacaatgccaaaataaatcatcctaaccatactcaagaatttgagttcggatcaagggttaataggagtatattcctagcctccatcgaggggcaacgagaatatacggttgccatatgaacaccagcgtaagatgtgagaccttttctatgtcggttggacctacccaactgataggactgctcgcagtgtggttgctatccaattggattttggacttcataaaatgtcatgttgtggtttgttttgtttgctattcctgtattttcacataccttgcttcacagccacataataacaatttttactatataatcttttgtctcgtgagagactttaacatcttaagtgttagtaacagcacaacaaaacatttttccttagttgccacgcaatgtcaaacgatctagtggactactttaagtatagtgggaatttagtaactacatcggttattaatgaaaccacaataagacctagcatggtcacgtacctaattttctataaaacaaaactccagacaaagtatgaaaaaaaaattgtagtgttactgcaagtgctgtgctgtgacaatagtagtaatattttcagtccttcaaattttcaaatacccggaaaactatataatgaataaacttgtagtcctttacattaaaattactgctgaattcaatggaaattgatccctcactattcctacgcattggcagaaatacctttatagataacacgcaacacctaactgtttcatccaaaatttatacagtggatggaaagattcaaatcaacttcctttctctcaccagaagtagaaagaacggttgtagttgcaagaaaatataaaaaaagattcaacagtacaacgaacatttcatcatttgattgtgtcaactaatgtgtgaccccaagacagctctatttgaccaatcaataataggtggcactaccaagcaagggaattctttgactgctgcaattttaagttataggaattttctatctcctcctgcaatattcattatttaaaatagttatgataggtaaggtaatacttgaatactgaatctgtaataaggtatcagataattaagatcaacaccaatgttttaaagaatttgaattgtaataaagaaaaacatacacgtataaatgagaaacagaaaatgagtcattcctagtattctcatattacttctttcacatggaatagatttttccaaatgattcataataccagtatcaaggtttttacattgcataagttttttaatgcaattaaatgatgtttaagggaaaatttctaaactttaccaacatttatgaaatgatctttttaccttgcaggcttttagtaaaggctgtaagaatgacgatctgaaaagtgtaattgcatttccaagcgaagttctattgaattctgctatcaaacaaggcattaaaaatcactttcccttgtaatggaatccaagttgcaattagaattgaaggaacatatcaatgtacataaacaggatccccagagtccaagacacgtggtgatggcaatgtgaagattttataaaacaggaaaattggattgagtataaaattaacataccaccatcaacatcagctcttgagacttcataattaagctcttctatcagctgcaatgttacatacaactcacaatgtcaagattcacataaacaaaagagatgtccagaaattctcagaaagcagcatccttatgtgttttccttttcacacatgaaaatgtgttggagaagggagcaagtgtcttaatgcaagttccagatcagaagtagtaaatacaaaacatcactattgaaaactaagcaccgttttggaaagtttttctctccctggaatgcatatcagaaaactatcattgcagaataagtatacctgtgaaagggtgggtactgtagtaggatcaaactcctcgcaccgttttggatcaatagggacacaaactcggcctagaacaaagaataataccatgtaatgctaaacagtcaaatgagctaatggatctatcaatcaaatttaactgggagatagttttttagtttcaattttatagttaaaaaataaaaataaaaaatataaagataaaatcataaaaccatatgattataatgtcaccagtgaattctcaagcctcataaaaaattcaactggttatgtcaataaaaattgtgcataattatatactaacctgttttaggatgtacacagaatggtgctttaagcaaatgattcatgtgtttagaaacctaaaacatgaacagtcttaatgaacaaaattcagactaaacttaaaattagtcaaaaggtgttattggtcttctatagagacattgatgggaagtataatgactgcagaaatggtaatagcatgaaagataacagtggctatgggaaaaaggccagttaaaagatgaacctccatatctagcctgggataggtaaagcagaacacaatctcttcaatgcaccgacgcagcccttgtgcctacaaaaaggattagaaaacattaataataaatagcaatatcaaatgatacatgtttcagcaaatcttgcatcatttcctgtattgtcaccttgttctacatttcttaaaaggaagcttgaataccttatgttttccagattgcagcaactgtttgcactgttcccatcgaacaacattgatgtcttcttttgcactagaagaccgcctactatcttgccatcttcccctaagttcagaagcaatggctgcaaaagtaacccatgtattgcataagataatagcagggagtgaaagagcaaggttcatatgaagggaggacagaaaacaaagtacattcatcaggaatcatgtcaaggatcttctcatatctctcctcggtagcaagtaaattttgacctgtaagcagatttttctcaaaatagtccttgagaacattagtgtatgatgtcctggaaaaataaaatactgcttagcatatgaaataagagatctggttcagaaagttaatgattcatattaagacttacgccaagaaaggatgaagagcagcacccatcaaagaaaccttcttgtgactattttcattgccctggacagcatatgaaatcaacaaaaagtttatacaagtattgacaaacccacttgtcatcagtatactataccttgtagacacgaaaatagtcagcaatagcacctctttgctcatttgtcaacctgtatgagtgaaggcaacctatttgaatttatgactgtacagccacaagtagataaaggataacttttgattgtttactgtttagtgcctcaccttcttgcctttccatcacagacccaacaatgaacacctctgcgcccactatatacccagagaatgtgtttgaaaccaaagtcatctgaaacagaagccccagagcaaaagtcaacacaacagttacaaaaaatgcagacacccccccccctcttctcccaaaacaaataacacccatttgttttatgcaatcaccactagatgggctcaatcttgccatatacgaagctattaaatataattttaatgcatgttggatattctatatccctccctcccatagtattttgaccattttcatatatgaagagcatctcaatccaaaggccataaagaattaggacaaaaaaactcagtcattgaataaagattaagcacaataaaagatcagaaatgggaagaaaataaatgcagaagagatgcttgatgaacctcaaagcatgtaatacagtaataggtgtaattaaaatcaaacaacaccataccatacatatatcccagagtgaatgctaacttaagcattgagcctcctctaacaggtatattaggcattgttgaagccttatatttcccaggaataacaatgttcaggaagttatgttgaaataatgaaacatacaagatacaccctagactacaactattatcataaattttcaagtagaaatcatgtctctttctgcttcagcaaaaataaacctatcatggtgagagatgaccaaatccagtaaagtcactttcccctgctatgttatgaattgggagaatcatacttgttgtgaggcaaacttatgttattttaggaggattctgccaggtgacttacatcaactccatggtctttcaatgttatatgagatgtaccgctatcttattatttcaataattgttttttcaatgtaatgaacaatataaatgacaaaattgcaccacttctccaatatcatataagatgcaaaatactacctcttaaggcagtgtcaatcactttgatcgctatagtcatcaacggccagcaaaccaaacaaacatcagcacccgaacagcagtatctaacatcatcataatctgacatatcctatagaaacccaaaatacaaaagggtgtcaaatgtgaagaaggccacaatagctaaaggcttcacttaaagactgaagcaaaaaatcttactatatcaaaaatcaactccctctcaactggggcaaagacattattatcaccactctgtgcataggcattcctttttgcaggctgaaccaaatacaaggaacatattaataaagaaaagaaacgctggttgcattaatcattatagctgcatgaattataaaagacttgaagcataataatgaaatctaggtagagaggatttggataaaagtggacattttacatcaacagtgtagacaggtccaatatctatcttaacagggcacttttctttgatggagttttcgagctcgtgggcattgtggaaagattggaagcgcagatatatatcattctccagagtgaaggaaaactctcttcgcccaatgtaggattgatcacaaccagggtgcttcccatctaccaaggaccaaaaaagagatgaatttttgtgaagaacgaaaacaacaccctaacatccattaaagggacgactaaaatgacacgatttttttagagggactaaaaaacaaataacctcctatttgcaaggaataaatatatatttaatccttaaaattaaaattaagaatgcatcgccattcaacacccattggaagcatggatttggcgatattattaccgttgccataagacacccatctgaccaaatcagcaaaaggaaacagctttcctggagaaaacgaaaagaagagaatagaaaacgttgaaaagattaaaatccagtacgaaacaatgaaaatcatgctaatttggtacagagattaaaagaaaaagacgaaacgggaattgaaagtaacgaaccgtaatatagtttgaggtgattgagattgaaatcgggttcttgatgtgggatcatttgctttgcgaccgaaattatgaaccgaatcaatcggagaattgtgttcacgaagtgggaaacgaagaaatcgagagcgaagtgattggtgtgtgtgaatgagatggcgggaagatcaacatatatgtggcgggaaactgagacgctaatgggcctaagcctcttttgcccatttcacttgctttcagggcctaggcctctgttgcttcctgcacttccattattatttcttgcactttccattacattatggataactcattctaaaatgaaaaataatggaagtacaatgggaagtgtaggaaacaatagtggaaatgtaagaagttttaggcgatcacttgattgggcctccacattcagttcctctttccaagaaaaaaaatcaataattgaaggcgatgattcaattaacttaattgggtgaatttataattaaattatttttatagtatttatctataagtaatttataaaaaatactgtatttatattcaattcattcaacaagtaaatctgacttttcttatgtttgtatgttcatttaaagaaaaggtaataacattgacacattttttaatacattatcatttattagttgaaatttataaaaatttatatttttttgtgtttcacatcttatttaatgattctatttcatgattttataatttctaataaattttaactaatatgatacacaaataatgatcaagcaaagattatcaacacattaatcatttgtatttgtatttaatcacttagttaaaaaaaaacatgtaagtatttaaaaaatgaaaaaaaaaacaataaaaacattagaaattacaatcaaagcaaaaaagcaaccaagtatgaaataaattaataagactttttatgaacttcttgcaaactttagtgcaagttttttttgtttttttttttttgaagaacttgagtgcaagctcagccaacttttaatgtctcgtgcatattctttagctttatttagaaaagtgacgtatttgtgtcaattgtgtatggcttggaaaattatgcaagcaataccaagtgggattgttgcttgacatgctatttgcaatatctcattgtttgaagaatttagaattattcttgaacaaactaatgtaaaactcttaaaattatagataatataaaaggaaaaaaaaagtatatttatatataaaaaaaaatcattttatcaattcgattttttattcctttggcgactcttatccttctcccattatttatcgccctttctcgatttttgcttcttcttttttacatatttatttatgcacatacatgcttcaagtatttcttttgcttaaatatatattatatttttttagaaatgatatacactgacaataatttgtataacatcatttgttgtgtctatttatctccgactcatcacttattacattttaatttttttttgtttatctcttttggttgtacaaattgttgtacaatttattatacaagtatcattttctatttttttcgagttattattcatataaagaatatatcatacaattttttttatctttatttctataatcacaataattatgtttctattttttctcttctcatctctccttttgttgtataaaaattaattatccaatttttttaattcaattaatgaaaaagctataatgaaaaatactagttaattaggggtagcatgcgtagtggccttatccaaatgaattcacctggaatatattataacaatatatttcatgtgtgtgtactagatgacccgacaacttgggcaacaattactcgtaagtttcagtttttatttttctttgcattgagttacagtttgttattagttataactatatatttcaataatacaaataatttaaggaaacttgtattttattttattgactcaagaaacgcaagaagggaaaacagaaatgaaatgagaagccatagatacgtgaatcttcttaacgattccatgcaaactatgtgcattgaacagccatatcaaatgattaagggttcaccaaaccacaaaatgagggtgacatgaattggtgttctaaccgtcacacgaacaaacagaacagcaaataaataattaagttccataaggttttcaaagattgtgtaccaatggcatgtcattacattttgaataatttgctcaacctttacctaccttgtctggcttgaaggaaatggcaaaaacaataaatggaaaaaacagacgctagcttctcacttctcaagtacaaatcatcacaatattactatcataaatatggcttcatttaagttgaagtgacgaataactaatattttcagtcaaaacatataagtctactcatgcgtctagtgtttaatgtaaaagaagtaccatgcagagaaaatgattaaacaattacacttatagaatgagatatatactattatttaatttgaataatataatgcaaaagtcactgtagctcctgagatatatcagactgtgcagaaagtatgattttgccgaagggcctaattatctcaattaaacaattaatttcaaatgaatcacgggacttgcgataattacgtcacagacaacagattagttaagcaattaaaatcaaaccctataactgtcccacctatgatcagtaaatagccttgggaatgcaatgcatagagccgtagacaacaacataacaaaacagagtcaaagttaatacttagtctgccatgtccaaaatattttaattaatctttaaaaaatttattaattaaaaatttatttaattgtttgataaataaattattttaataattttttaatagtttttaatatttttaaatgttatttaaagtaaagttttttaaaatattaattctaacttataattttttatattttttatttttattttgaatatatttatccaatttttttattatctttctaaataagtcacatatttataagtcatatgttctttattttttaataattttatatttttcaattgtttcaacaaataattttatcgaatatttattatttaatatattaattttcaatttttaattatcaactttcaactatcaactatcttttcaactttttctttttatcttaatataaactttttccaataaaaggaaaaaatgctactaccattcaacatactttttcaaacaatctttgatatatacaatgtttcactaaataaaattgcacatatattttatctaacaataaaaaaaagttatatatatatatataaaagaattaaatcttactaacccgcgcgtccggaccggacacttactaaataataaaaaatatttttttaatatatatcacatattcatagagagagaaaaaacatgaaaaatataatatttcaattaaaaattattcttaattccttaaccaagacactactcagtactgtcatcaatgttctttcagaatatagaaataaaactagaactagtagtcaacgacagtttttattgataggaacaatttgactagggatgattgtgtaattggtttaaaaagtcaattgtttggatgatgtgggtgatctaacttgccattggactgtggcaagagaaaatggaacaagtattggatggaaatttatttgacgaagggcttttcaaagggatgatacacacatgccgatgtcatttaaaataggaagcacagtgtgtgtttgggccaatatttcaaacaaagactctctcttaagcggtcaccaacattttaacctacctactgtatttatgtcagcagtagccaagctaatattatctggcaacatgtagagggcacttgcatgaaagaaaaaatgctactattatggccaatgcttaaaaatggtatcaaaagaaaagaaaaaaaaagtggaaggtgaagttattgccagcggtgtggttaaccaaatgctaccatgaaaactttctcctgcacccttttaatgactctataaatattctctgcacactttgttcttcaccacagatagacacagtcccactcttcttattccatttactctcttgctccttctctttatcatcaccatcaaccaatttgaaagaaaaaaaaatagcatggtgttcccaatggtgcttctgaggcttgcagactgggtcttgtaccagcttcttgctaactcgtgttatagagcagcaagaaaaatgaagagttatggattccatttggggtatttgtcatctaaaccaccccttcaaccttcttctttccctagtgttaccaaatgtgatttggagggtagaagctcacaaacacttgttgcttgtgacattcatagagtccttttgaggtcccactccttctttccttatttcatgcttgttgcctttgaaggtggcagcattttaagggcactcctcttgctcttgtcttgtcctgtgttgtggattttagaccatgagttaagtcttagggtcatgaccttcatcaccttttgtgggctaagaacaagtgtcatggaaaatatgtcaagggctgttttgcccaagttttatttggagaatctcaaccttcatgcttatgaggttctggcctcagcagggtctaaagttgttttcactactgtgcctagagttatggtggaagggtttcttagggagtatttgagtgtcggtgctgttgttggcacagagttgcacactgttggttgctacttcagtggtttggtttctggttctggcttacttgtgaagcacagagcactgaaggaatattttggagacacaaagcctgatattggggttggaagctctagtgttcatgatcatctttttctctccctttgcaaggtaagtctctagttagctccactgtttaatcacctcactaactgtttaactcttgcgtgttcaatacttcattgttcttaaataacctttcactgtttccacaacaccaaggacctgagaccttgttacacgccttaataaaaaaaacaaaaccatttaaattgaaaaaacaaagactaatcaaagttgaaagttcaacatataaccttgtacgtattattctggtgaacagttttaattccctttatgatatgttctgttagcacagcatattataaatctattgcatttatatcaagattttaacctgcagtcattgtctcgattgtgtcacgatctttaatattgtaggaacttacgaacaaatgtaaccaatgttgttatagttttagttgacattgcggtcaaaattgcagtcacggataatttttttttttttaaatcttgatttagattgtaatttagtagacatgattttattaaatctattaatgtattgtgcctaattccagctacatgataatgacaggaagcatatgtggtgaacaatgaagagggcaagggcaacccaagttcagtgttgccaagggacaaatatccaaagcccttaatattccatgatggaagactagcattcctgcctactccctcagcaactctatatatgtttatgtggtttccattaggaattcttttagccatttatagaatccttttgggtattctacttccttatggatgggcaatggcattaggggtttggagtggtataaatctgcaagtcaaaggcaatgtccctgatgaaaagtcagagcaaaacaaaggggtcctatttgtatgctcccacaggactctccttgatcctgttttcctaagcacatgtttggcaaagcctttgactgcagtcacatacagcctaagcaaagtgtctgagttgatagcccctattaggacagtgagactaacaagggacagaagaaaagatggtgaaaccatgcaaaggctcctcaaagaaggtgatttagtggtgtgtcctgaaggaacaacttgtagggaaccatatttactaaggttcagctcactgtttgctgaattggctgatgagattgttcctgtggctattaatagtcatgtgagcatgttctatgggacaacagcaagcggtttgaaatgcttggaccctattttctttctcatgaatccaaggcctagctattatattgaggttcttggaaaggttcccaaggaactaacatgtgctggaggaaggtcaagctgtgaagtggcaaactatatacagcaacagttggcttgtgctttgggatttgagtgcaccacacttactaggagggataagtacatgatgctggcagggaatgaagggattgtgcaagaagacaagtggagaaaatactattgatagatatgaaaaaaatatatgggattttcacttttcaatgatattttgaaatgtcatattgtattatacacttatttttatgttgccttattttgtgcttctttcttcttcttttttttttttttgttcttgttggatatgacatttatgattgtgatattaacggaatgacagtgtcaagcaagcatatttactttacgtacactgtgcttctttaaagtaactaggacttgactaggaatatgaggttacataacttacaccaaatttgtatttcacttttttgtaagagttttttttttttaataaaaaaattgtctcttatattaattaatatttttatcaaaataaatttaattcgttaataaataaaaaatgttgtaaattgtttcttcttttcacttgtgaatattggagaagataattctataaccactattttctttatacattaattaattagatgtaatgaacaaagaaaaaaaatgaaatgattagttaccataaaataattttataaagatgctataattattagtaaatttaatgtcattgaattaactactttttttttaattcttataaattagttagaagagttttacagggacaaagatagtattaacagaaattgtacatcttaaaaaatgttcagcctgtgtacttatatcaaggaacgtgtctattctgacggatatagtaagtaaaatacaataaataacaacaaattagagaatcatgcaaggcaaggtataataagaataagaggagcacttcaagtcatgtctattgtatgtctgagtgaataaaataaatcaatactttgctcatgtgtatattttttaatctttaagtgattattttaaactaagataaagttcttcccccccttttatcattatcatgacgaaaaacacaaacaaatatatgcatatgatgttgacaggtagatagacacattaattttattgattcaaggaattaatgtgtcatgggaaagatttatctaattaaccttgtctgttgcaatgtgacaaatttggataggggtttaatatgttgacacgttaattttcaccgcatactttttgtgggcagacttttaattttttgtcgatacgaatttagttaatttaactacgctaaaatctaatattcattaaatgatattgtatgcactttaatattactatatgataaatattgcaaaaaaaaaaatacattgacaaataatcaaaattaattgctagtacttaatatctctttgtaaacaaattgattaattaactcatcatatttttttcatgacataaattaaattgaaaaagtaaaaaaaaaaaaaaggttttagcaatatgatgaagaaatgttaataaaatagaagaatttagaatttagccttggtaagatatttttgttatcctattattatcattaggcatattcaagcaatattgcactagggtcaggggaactaccaactaaactaacaagactacaccaacccctttgctcaagactttaaatatgaagacacgttgcttctatgggccaaactgaatcaatgttttagtcaaagtcaagactgtacttgggcataaagatcttacaaaaccatggaacagccacatattttatgatagttataaattttgtttattgagtcattttttactatgaaatttaaaataattctgcattttgttctataaagttattataaaaggaacttatttaccaatttttaatatcactctccaaaaaacttataaggttagacaaacgtaaatgagtattaatgttacaagaaatagtaaaacattcttataacactctttgttgttgggtatgtgactatgtgagtttattaaatggaatgtcggttcatcagatttagacatttaacaaaactcacgtataagttatgaaatatttgtacaaaaatattttgcactaactataaataattaaactcaaataaaaataaataaataataaagagttttatacacatgcacacatatttgtctttttcccatttatgaaattagttttctgctattagctagttagtagatcaaataattaaatgtatgtttaactgtcaagtagtctattatatcattttgggtgtggttgagccgttgagggacaataataagaataagaggcccagttaacaatgaatatatttaaaaagtagtctattatagtattgacaataatttcatgcctataaaaattgttaaaagcatcattttgttaaattaaatttaacaatgcattaaacttttggtcataaaatgacacaatcatgaatccacagttcttttttttttttttttgtaaaaaagaggcccagttgagaatagcgaagtccactccgagttttagccattgaacaatttcgaaccgtttaccgttttttgtttggataaaggaaccgtttactgtttgatacgcaactgcagagaactatcaaacaaaagagagataccagcaaaaggatccatgatattattttctttaaaattaattactatttaaatttaactagatgcactcatattgttaaaaaaaatatactatcatttaattataatttgatatgtatgataaattgtttgaattttataattattactttaaaagtcacacttaaaataatttctaattgattgataatatatatatatatataaatataataaatatgagaattataaagaaaaatgatagatacatcatacatgttagaaatctcataatattttcacgtataaaagaaacaagatattttgagttggatatagtatacatgataaatttactataaacaaataaaagaattagtgatcaaatttaaaggcgaaaattattttttttatcattaatcgccacaaaaattttagtgatagtttttaaaaaaaatatatttaattttcccactaattttaatttttcttatagtacattttcttaacttgtcatttccttgcgtgttactccttcagtgtagttatcattttttttcaattacatgaatttaatagtacttctaaattactcttatttgtcgattaagtaactgcttgctctaaagtaacaaaattcattttcatgcttttttttaataaaaaaatacacgttctaatgtaagcgtgtgatttaaattaatttagacacacatattaatcacatttaaccattaacagcccaagctcgattccatgaaaaataattctatcaaaattcaaaaccatactaacaaattaagagttaatgtctgtaatagaagacacttctaaagttcgagacaaaacaaaagacacttttaatatgagttaggttttaaaataagttaagatgaatttacactccattttatttaaaaaagtaaattatctttactttcaaaaacaaacttaattttacaaaagttattttaaaaaataattcatataaacttagttttttttttatgatgattagttttcttttaaaataagttaagatgtgaatttaaaggtcactatatattatacatttattcaatgagttttactaactgatgtcttaaagacattagttaagaattaaaagaggatatttattgtttattatataaatcataaaaaataaaataaaaattatggacagtataattatttatttctcaataaaaatatttttattttaaatttcttaaccagtgttgttaatgaaatgattagtatttaccttattgatttactccaagcataataggtggtgagtgacatgttcctagaatgttcctagaaggtagttcaggttattacttgtgaggggtaaagaagggtgttggttgtatagtgactgaaaaaggtaacgctaaacctgttgtaggtgacattgggactgtttattctcttcctgttttgcatagttgaagttgtgagaatttatgagtaagggacctgtgccttcagtacatgccatgtaaacaaactccaatggtcataatcaaaagatggtacccaccactatacatattttgtaatgccaacatattgatcttaattacacgttggaaaaaaataaacatctaagaaattatattttaaatcaacatgtatacattatattgcaaattgtgcaacaacaattattttattggttcaaattgttctataatgatattttatataaagcaaaacgtaaagaaaaattgtttgtatgagttggtcacttatatatgtaagaaatttacatctttttagtgtaatccattctgtttgttaaaaattagattagatgtagatccttagcttagacaacaaaactgatcctggtttatataactaaaaagataaggtcataaggcaacttcaaagatatatttatttttctaagttctaacaattctaacgtaaaaaaatgagcaacacaaaaaaaataaaaaagttatgtacagtatatatctctacatatgtccatcatcttaaattgccttttctttctaccatgtgtttctaccatttatgtgctgttgatggtcatgtagctattggcttttatgtctcccaaaaagtctgtaaaaggggcaaaaattatttgctcagaacagcaacatccaactctcaaccattttagagataatttctttgcaaagttgaaattatccacagaacgacacaaatatctgcaaagctatttaatgtgtcaggtgcagcagcagcatagggagagggttctgtaggcactggcactgaaccaaaaacgttggcaccgcttgagtttgttgtgttcaacactgatgtactagtgctgcaattttaggtaccaactattaagttaattaatatgatattttctgttccaattgttgcaacatagtaacaaataaagcatagtatatgtatattaaaaaaaatgaaaccatatatatggcaagattgggtcacctagttgatggatattgacatgccccagagcctgcaaaacacgtaaatgcattcatcaaatgttctcaacaaccaaaaattaaataatattggaggaccatagtgttctatgctgaaaaataaaacaaaaatgtacatcaaattttaatgtatatgttctgtaaaagataaagataataaaaaacttttcacaacatcattaatattagattcttaattgagatcttagatcactttttaatatcatgttaaaagtaaaattgaagatttctcaagatattatagatctcattttgaaatattaggggaaaagaggaaaaaaatattcttttttgaacaatattcttttattgacaatattcaaaatttttattcaagatcttacacaaaatatttttatattcgaaaaaaattgttataaaaatcgtcacttaataggtgagaatgaatattacaaatttataattggttaaataagcaagacattcaattaagagaaaaagaaactaaaataagtgtatatatatgtcattatttttttgaaaaatttttttcataattttttaagttaaaatctttaaaaaataattattatccgtaaataatcctaaccactaagttcataaattttgtacaaagcattatgttacttcattttgaatttaagtggctaatattatttttctctgtataattcgtaagcaaggtatgtaagcacaattaatgaaaaaaattgcgatgaatagctacttatagatactatttgtgataataggtatttaactcttttgtattttttcttaatttacaaaataaataatagtccttaacattaataaataatattaaatataaaatattatataaaatataaaatatataaaataaaactaaaaaatatacattaaataattaaaataaaaaattacttataattaagaaaagtacaaaaaaagaatttgaagacataaaataatttactacactaatgaaaaaagaaaaaagttattttacaactttaaaattggctgagtgaaaaaaaatcttactactttaagatgtgttcaaaataataaaaaatatttgttttatgattttcatgtaaaaaagaaataataacatatgttataatttttaattcaaaaataataaattacctacaatttacctattttaaaatattaatttttaaattttatcttcaaatgataaatttgaaaaaaaattaccccaattggccaataaaggaagctttttggagatgctgcttccaaaaaagttgaataaaagtttgacttttgcatcacgcagatgtcagctttgtagctcctgcatccccaaccccaagtgacaggctataatcaattcaaatatgcaataaaagtttcttccttttgtagtcttttcagaatggaaggaacccaacaatcatgcgcagggatgcgtctgattaccaacccaagggacccaacctctctttggcacaccagagatttaaaactcaaatcgacccgataagttgaatcacgattcgataattgaataggattgactcataagttcaattggttacattttttaacccaaaagcctcggtcggaattttggttgaacggtgacccgtcgatccagagatggtcacttatttttttttttttgttataatcaaaatgagttaatttaaatttaaacccattttaattttaaaaactttatcgacctatcatttttcttctcgtagtctcattcagtgtgttcgacaacctctcattcttttctctcatttgtaagttctccagttgcaagtgagtccaactaaatttattttttctttttcattttattttattttagtttgtgtgtgtaattttgaattaaattgatcttttcatttattgttgagcctttcttgtggtcgtaattgcattttttgctaagttaaattgatttaaacgtgaccacaattgtgtttgagtttcaagtgaaattgtggtatcggatcattttttaaaattgtgatttgaaactttagattgaacttttatattttataatctacattgatgtgatatgactatatttcattttagtgtgaatattaatatatattgtcgttgatgttaaatgttagagataatagtcattttttaacttttattctttatattttatttgtgtttttaatactttttaatttcaatgtatttcaggagaaagattttaagatagatataaaaattttatattttttattacagatcgagtcatgcggatcaattagtgactcaccaattcgaccactgatctaatgacccaataccatgacttagtcacctaacccattttaaaactatgtgacacacatcttctgctagtttgcatactcctttccttttataattatattttcatcatctactaaacttcaacttctattttctaagtttaatttttttagttttacaaattttgttattttattttttgtttatttgtgaatttgatctctatttttaattatgcattaatttatatgtcaacttataatctaatatttaatataaatactaatataataatatagtaatagaatattatgtcaatatgaaaatattaatgtgataatgcattatagtgacatgttaacatttctattaaatatcatatattagtaagtaaacagataaatcaaaatggcacaactaaaataatggactcaaatttggaaggaaaaaaatattgaaagatgttgtgaaattgaaaaggtaaggaaaaaatttgtaatcaagcctaatttttgcttgaattttcaatatacccaacgacttgaccatacctttggacttgccttaaaattaaaatacatgtgacgttattgaaaaagttgcaacgagaattataatagcaaaggccttacttgggttagtgctaatgatgacagcagttccaccaaaattgcagctatttggaacaggattcttttgataatacttattgaaggcataagaagcatggtccctgatggaatgtgggttgtaacagcttccaccaggttgtattgctgagcaatcagcaccaccatagccacaagcatagtccaatgcaacttgtagagtagtctgtgaggcagttgggcttgcaatgcaccagcttgcacctgaggagattggagaattcacagtggttggagtggtaaatgggattgtggaggctggagagactgtgtctggattgaaattaggattggaattaggattcaggaatggagatgttgaaatggtgggagtggtgggaactaagtttggaatggtggtgatgggagtggtaatatccctttggactgtagaaattgaggcagtgaattcttgtttcccttgatcatgtcccagtacattcacatatacaggtacttccttttgtgtcctacttgaacctatgtttgaaataacaactgaattactttgttctgtactatatgtccaaagcatgtgaagagagaaatcaaaatatggatttgaaatcaatccaagccttttcctttttcaaagggatgcaaaaaaagtgtaactggattcaaattgtgcctataaggctataacattcatgctggtatggaaaacaaaatctgttttgctattcattggaatagttgtagaaattttgattcaaactaattattatatttatgcccttaagacttagacctctccattatttcaaaaggcaacaacttggaatagtgcaactagaagggcagtcagttaaggacaggtagggtatactatgtagagagaggcatatgtgaatcaaagcagttgggccctttgtatcttttcaagaaacggtggaattgcagaaaggttggatgcaactgtactatgtgaaaccccagaaaaattagcaagaaaaggacttgtttaaacttttctatggtgtggctctataattgctggaacaagtatttaatggaataatacaagagacagtattttgatctaggaaacttattatccataaacaagaaaaagtgaaaagctcaattagtaaactatattccaacagaaagaagccaagatggactagcaaactaaaaaaaagaagtgattttctcctaatcagtccaaaatttatatccataatggtactagttgaactaaaaaactagaagagaataaaacaattgagatgccaaacttgagagaaggaaaaagctttttgtggtttcagaattcaaaacaaattcaaggggtccaaaacaatataaattaaagagaaaaacacagaatatgtgcaggagataaagaataagcaattggaaatttgaaaaagaaggaaaacgagaaccaaagacactgagaattaagaaacaatatcagaatagagccatcagagctaaaccaaagataaaaaagaagaagaaggaagatagaagaactatagaataaactagacaaaggggattacctgaacagaggaaatgacacattaagagaaatattacatagtaaaatacactcctttccatctttaatcttagtattcagcttcttcttctttgacacttgcttgtcctctctcacttcttttttaatgtggttccccagtaatagtagtttttcctttgactaaatggagaaaggaagatatgatgaactagagacggaaaaaaaggaagatggttgttttgtgggttaatcatgcaactaaaagtatatatagtggtagtggaagactgtgaggttgtgagagacaaaggagagggtttaagaaagcgaaaatggggtgtggtgagggagagtgttggagggtgcaagcaactgaagcaagagaaggagcaaaaaggagggaaaaggtggggaagaaggttgaaaacgaagtaaagaaagaattgtttggaatatagactcggtttgtgggcttgtaagtgatgattgtaatgatggtgctgatgtgtacaatttgcctttctctttactatttttctgcttttactgttgtctatgacttattctatttcttcttcttctcttgttttttctcctttattcttagtaggatctaaatctaaactataaaatgtcttgcattatgttagtactttgttgtggaagtataaaattataagttttgttggatataagattagaagtgtttatgagaatttctctactggaaaaagttttatatttctattaaaaaaactttcaaaaatactcatgacttgtattcaaatagaccatatgtaaagttcaagttgctagtggcttatttacattttgtcaattggagaaaagagacattgtggagagcatttggtatgatagaagttttttgtttttttagaaatcatatgttaagaaatttaagaggcattgatagggataagttttgagtttctaggaatcttgattaggaattttaattttggataagttttgagtttctagggaatcttgattatgaattttaatttttcatggttgatcatcgttttaaaaaaataaatttataaaaaataatatttcagaaatatttttttaacatgtttttctacgaaaactttctcatgagagatgtgagaatacttttttgagattaattttttttattacaataaaaatattacctttttttttaagtcctatgacacttacataaatttctgatgaccaatcaaacaaacaaattttactcattttatggaaacaagattttcgagcatgaaattttttttcttctaccaaaagcctccttagttttccacgtgtggtatgcattttaaaaaataacattcatgaggaatgatgtttcccaagaatattttttaatcagttttttcacaaaaacttttccatagaaaaggtggaaatcttaggtgatacttggtatgaattttattttcagttttcattttcaaatttacataaaatctaaaatcttttattacttaaaataatatacattagccaaaaaaacttctccccaaaactaaagttattttttgtaattatacaattaattcggaaaataatttattgtcaagaattaatgattcaattatttaaaatacaaacaatcataattgattttttttatttgattgacaccaatcttagaattgaacggtcatttaatttaaaatattaatgataatatgataatgtagaatttatttacgattgataaccatccaatccttatatgttatatcatgaaaatcatagcctattattattacagtattttcgggttttgattaaaggttacatgaatttatttataacttatttttattttaaaaatacttagtatgttataaagtgctaaatgaaagatagtaagtgacatattagaggatgatcaaatgcaattgagtctcaacttattatttttttagtcaattttttcttatacaaatatcacattttctttttagtgttgaaaatggtaaaatggaaagatatttcacatactactagataaaatgtcatagacatgctaggactgttaattgagggttattacctaaaggaatattgtacatgctagatcctcaagtaattctattaggttgcaactactcagttacaagatgtcaagggatctctttgaagaaggatgcccaccaaccagagaaagtgacatcaaggagattcaaacccacacccatgaaaaatataaaagttcaatctggattgttaaccactctgccaacccgcattggccacaaatatcacaatttaactataaggttaaatactttgacatgtaattcatttggagcttaatggtaaaaacaacttgaaaaaggctaaatagcctacaaaagaacctcgaagaaaaaaatgcatgataatagaattcagacattagaaaaatactatttttttaatagtagtaattagagtttttgtctttggctgaaacctcagtatttttacaaattttgaatctttaagctaattataggactaatttttgattcaaacatagtgatatttaaagttattcatattttttcaatgatgtattctgtaagatcaaactcatatctttttacacaaactcattacattcatttgaataggaaaatactataaaataatgttgtaaaaatattagaaaataaaactaaagaaaaaaaatagataaagtcataaagacactcttttaaagtaaaacacaactaatctaataattttgaaatagataaagacactcttttatattatttgacttttttggacaaacaaatttgttaaatatttttcctttctttttttggctttaaactattgaatattaaaacattcatatttttataatcatgtattgattcctgaattatttaaaagaatccactaaaataaaaaacattttataattttttttctaatttgataaagaggggataacttttttcttagatatttagtagtcccacagtttgcagatttatatctagttagttatgaatttccagctcaaaagggaagtgtagagtccactcatcatctatctttccttagtcccgaccacacacaatgacaatgtcaactctttgttctgcacttcctccattatcatcatcatcatcatcaccctccatagcaaagttcatctccgaccaaccatgcctcaccatgctccaaacccaatgctccaacatgaaagaccttcaaaagatccatgtccacatcatcaaaaccggccttgctcaccacaccgttgctgctagccgcgtcctcactttctgcgcctcttcatccggtgacatcaactatgcctacttgctcttcaccaccattccaagcccaaacctttattgctggaacaccatcatcagaggcttctctcggagctcaaccccacatcttgcaatatctctttttgttgatatgttgtgttcttcagttcagccacaacgcttgacttacccttctgttttcaaggcttatgctcaactgggtgctagctatgatggagctcagcttcatgggagggttgttaagttgggtcttgagaaggaccagtttattcaaaatactatcatttacatgtatgctaatagtgggttattgagtgaggctaggagagtgtttgatgaacttctggaacttgatttggtggcttgcaattctatgattatgggccttgctaagtgtggggaggttgataagtctaggaggttgtttgataacatgcctacaagaaccagagttacttggaattctatgattagtggttatgttaggaataagaggctgatggaggcattggagcttttccgcaagatgcagggagaaagggttgagcctagtgaatttacaatggtgagcttgttaagtgcttgtgcccatttaggagcacttaaacatggggagtgggttcatgattatgtaaaaaggggtcattttgagttgaatgtcattgttctcacagcaattattgacatgtactgcaagtgtggagctattgtaaaggctattgaagtgtttgaggcatcacccacaagaggattatcatgttggaactccattataataggacttgccatgaatggttatgagagaaaagcaattgagtacttctctaagcttgaagcctcagatttaaagccagaccatgtaagtttcattggtgttttaactgcttgtaaatatataggagcaataggaaaagcaagggactattttgcactgatgatggataagtatgagattgagccatcgataaaacactacacttgcatggttgaagtgctaggtcaagctgcgctactagaagaagccgaacaactaataaagggtatgcctctaaaggcagattttattatatggggggctttgctttcatcttgtaggaagcatgggaatgtagaaattgcgaaacgagctgcacaaagagtctgtgagttaaatccaagtgatgccagtggttatttacttatgtctaatgttcaggctgcatccaaccaatttgaagaggcaatggagcaaagaattttgatgagagaaagattggcagagaaggaaccaggatgcagttcaatagaactatatggagaggttcatgagttcttggctggggggaggctacatcctaaagctcgagagatttactctttactgaatgactccagttttgtacttcaagattgattatctccgaagggatgaactcgtgaaatttaaaaatcaatctgtatgtaaggaagtagctttaatacagagaagagttacaatatatgaggatctaacaatcgaaccatatatccaatttgtttgtcaatacactgggatttttagtttaattagggaaaaaaagttcctaaagtagaaagagtaagataggggcacagggccatgacatgaaattcaaatatgcaaaaatccatttcattatgttatattttgtcttcccaaattattccagtcatattggtaacataattagaaaacctggtgtctatttaagcttgtataaatttgaatctaggtcagtctgcagggctaaaccatgcataaggtcactcaaactcttgctttaggcctccagaaaaaagctatttagtattgatatttatacaacctttactattagctggtttagtgttgtgataactaaagtttgcttttttgctagtgaatgtaattcaaaccttgctagacttaccaatctcaacttctgtgcttcatgcatgtttgctttgaagttctaacacaaactgctgcgatatgcaatattaactctgaaaagtagatcttattgtattgaaaatcattacacccattaatttgctaaaataattcttaatacatcagaataagcatatcatcttgttttgcaatgtcaaccttggaagacccctgatagctacagtacagtacattttgtgaatgtgagacaacaactaacaaatagtagtttcaggtttttgagaagttcctccctggtgcccaagagtatatctctgggggcattgtaccattcatgagcaggttctgtggcattgcatacaagtcagaaatatcaagatggtgagtgcgtccattttggtaatgctgattctgcattgcagaagcaagttcatcatcttccaatggaaggcgatcgaaagtagcatgcatgaatgatgcagccatgattacaagagggcctgaagcaatcaaagcaccaaccacagcacctcccacaacttgcccttgagcacctgccaagtaaattgtgaggcctgtgatccctggaggggctggtgggggaaggattgaccccagcagtgaaagaatctcgaatcgaccgtgaagggtcacaatggcaccagctgagcctggttggcgcaatgttacatttgttacacagcctgttgcattgagtatgtaaaggccacgttgctttctccttgcaaagttcaacaaactttcattcacatcacagcctgagctcacttccatggcatgagccttcagtgcattagcactatctctggtgacaattattggtggcttaggtttgtttttggagccggccggccggccacgtggtcgccttaaggtgtccccttctgctgccgaggaaactggtgaaactgcttttgggactttgggagatattagagctacatcaatgccagacatgtttgagtttcccttgtcttgttcttgctttctatccatttcaccaaacataagacactttgaggaaaatgtgcagtaacaaagagcaaatcgctcttttctgcttcatagaattgcttaagtagttgaattgtgacaataaattttataggatcccaaaagaatgattattttgtaggatggagttaagtaatgccaaccaaccacaaattattgttttttgcattactcagcctaactctgcctaacttggctcatgtcaattgccttctccaacagatatctcatggcatataattattacgctttacttcgcaatattagccacctacacctcctttctcacattataataatatagaattgcatgcccttttgttccaaacatgatatgcgtgttcagttctgtctgatgcatctacaattgaacgctcacgcacatatgaatgacaaaaatactctatttcactccctcgtgacaaaaaagaagtcaactgtagagaaagaagagcaaggaagagggaaagagaggggaatttgaagagaacattgagtgtgtaattctgttcggcccagtaacactgcaattattctgttagctctgcaactaacactgcaaacagtttttgccgcataagcaattgtcaactaattataaaaaatgacagtgaagagtgatatgtggaaaatactaagctgctagtgatttcttgaccagttttgatgctcaatgttcttgcactgtaccattcttccactagggaactttggattaatgaacttatttgtgcttttgagttcatgaggggacagagaggaagcgtgaccaagaagaatggcttccaaggcaatcaagttcttcctggcctctgttggatgacaagtcttgaaattctcctttctgctcgaggtcttgttctgtgtctgctgagtcctgagatttaaagaactttgctggataatgcattgaaggacaggttgaggaaccggagggaggtgaagaggcggtgaatcatgcaaactaccggctttcaccaagacctaaggaggtctcgaggctcaaaaaagcgcttacaaagatgcttatagattatctctcaccaaagttttcacatcgacaatagaatgaacttatatatccttaaggaatatgaactcagttcttaccaactgtactaacctttgttggcatttccaacatgtttggagcctttgtttcacagtgtctctagcaaactctgagcctttttatgttatgcataactgtagagaagactgggagaatagaaggctctcgtgcttttggaatcttgacatgatccatgtctggtcttgtattccacagtcttaccatgttactgtttgtttactgttttccagcaactgagctcattggtcaatggtcatattgtttgcctaaatgctcctgtagcaacaaatgtggtctaagcatactaaacaaattattggtgcattgcacaaatatttccaaagtataagtatttttttttttacattaaaacatgtaaggaaaatatcatgttactaaatatgataaatttacacatatgaagaaaaaaatattaaaaatgcctttagtattaaaataggcactttattttattaatatatagtaaataaattaaagatataagattactaaaactgtggaaggaattatggaaataaattatttgaaacaagatatattatctttgtgtatgtttaatgtgatatataaaaattaaatttaaattaaattttaataagatgacaatactcttagaaaaaataaatctcatcaatttgatatattgtaactagattgtagttttaaaatgcaagtcaaatttttaaatcaaaactaattaattaaattaagtaaaactatttcaaataaactataaatttgtagatgtcatctcatcttttagaaaaactatattagtgaatatctaaaaattagttaatgaagaacttatttttgtttatgatcattttttttcttattttcttcttttagaaatacttttaaagaagcttatacaaataagtctttagttgattcttataatttttatgtagatgaatccaatgaaatacactttacacattgaaataattataaaaaaaatcaaaatcatgtctagaaatagaaaacataaatattttaaaagggttaagatgtcattaattaaataagagactgttcttataattagtaagttattaaaaactaaattattcattttcaatattgaaacatattttcaatagttaggctctgcaactagtaaaaatgaaagaaatatagaaaaaagataatacgtagaaagtaagctgctgtcagtggtagtttgttggccaatttcgatgtaatccgtcggatgacaaatcttgaaaatctccttgctgccaagttcttcttggatgtatagggtctgagaaggtaaaggtacaagacttgtataatgtgtagtagtcagaaccagattatttgtaggactttctgaagtcagaatatgagaatgcacaacacttggtggtggagaaggagccagaatgtgagattgtacaagtgtatacggtgagggagccaaaatctgatgagaatgtgatgataaagacaaagatcttggtccagctccatgacccaataaaggaaacataccttgctaatattaatgagaataaagatctagttagtattagtagagcagaatcatgaaataatacaacgcctaaaccattaaagtagagcttatgataaaatcttattgaagtcacttgaagaaatacacgcatggattattggacatcaaggaagacacgatgagataaaggtcaagctttaaatacaattgataacttggtatttcataccaaaatatcttgtatttaaaagtggatgatcacgaatctagatcaatctgataactcgatgaaacccaaactaattcaacaaaaaagtttgaatggttcggatcattgataaaaattaaattgaaaaattattgatccgattaattccgatggaatcttaaattttaattttcagaatctgatctaatttatatctgattcaccaaattaattacttattatatttaatttttatatattttttaacttttagagtttaaactttttagtccactccaacttttttaaccctaattcaatatgaaacaatattttatgtctttagaataatcaaataaaaaataataatcaaaccacaatcttaaaaaaaagaagaaaaaaaccaggtaactatataagtttttaattaattaagagtgacatttctctttgtcaagctaaattttttcaaaatataacctatgtaattaccaaaatttggaaccgatctaacattagagttaataattatcagtattgattctagtgatgagtgttgattccagtgatctttgtgatactgaatccgctagtatcctctacttgaggaatgacaaaagatacctgcaaaaggaattctatactcaagtgagtgtttgagggaatagtatattagaacagttcaattaaagtaaatataagacctgattatttataatgatgggtgaaaatcctatattgttaacttagaggttgttacaatagcataacaacgactttagtaaggtgtaaccgcattacaacttcgtaacagaggaactgcctaggattggccatatggagaacatccatgctcgtggcccaagaatgattaagatggacggctgacaagaaatactcattatcgtattactcgccacgtcaatcgtagactccagacattacaacccttttattttcaaaacaaaaaattcctttttcaagaaataaaaatcacacgagattcttaactagaaatatacatccattttcttaaataaatagataaagtttcttcctcattctttttacaaacaaaaacaaggaagtaaaataaaatcataattattttacgcatttggttaagagtaactattcttttaaaacgtacataataggatattatcacttttccttgtgtatttagctcctaaatccaaacttcttttctgaaaacattttctttttcttttaaaaaggggtttcatcaatgttatttctaaattaaataaattttggtgatgagtctcatttgttattaactcattttaaagtttttgttcgcctccgtcatattcctgattatgataaataattttttttttaaaaacctaataccctattgttgacaagaaatttttgcaattttcatcgaaaacttagattttaaatctagacaaagatcattcaaaaaagaaatctagatagctagagagaagagaatcacatcctggatctatttgcttttagcattcaaattaacgttgtacgggatgaatgccagcaagtcgatcggattgaagttaccaagtctaatccatcacaaaagcattcaaatatgtcaacaatttcatgctcctcgtaaagagttttcagttgtcagagaaagaaggatataatcatgaacccaggaaatcttgcttgccatccatttcttttgatttttttggtcaacacaacatatatattaaaagaaaattaactttgttataatgtaagattatttaaataatccataaataaagaaatatcatataatcataataacaaatattcacttttattattattatttttttaacataagtgaacagatataatttattgataatttaaaactatatatttaataaaatctaatgtagtattattatttgagcttaattaactcaggtagttaaactaaaaattccagcttgtaataaaatcctgtggtccgtggtcaggcggagtcaagtcaagggaaaggcaaagcaatgatgctaatgctacaacctctattttagttttcttttctctttatttctaatatatatgaatactttatattctactttgtaccaaaaattactttatacttgactaataaaaatatatttgtttgtcaaatttatatttattgataatggataaaattgcgccgaatgatataaattaccatcatcatactctaatatgctatcacgtaaataaaaatctcgctaaccattatatgctttaaaatactttatcatttatttttgtttaattaattataaaaatctaaaaaaactcgatgagaaatgaaatcaacagctaatgtatatttaaaactcccacatcaaatattcttaaagaattatattggacaccactaattaaaatatagtataacatcatgaactatgtttttttttttttttttcatttttgtcaataaattcatgaatcctaattacttaaaaatgaatacaagaataaaaagatgttgatcctccttttatcgacgttcctttcagcttggtttggtggggacatttaggatgtgctctgattgttgaatgggcggtgctctgattgttgggtttgcatttttgcacccaccaaacagaagaaaagtctttggtttaccaacttttcttctcagagatattagatatatgggaattgggaatgggaggtcttactttgagaaggagcagacatatatattattcagtaaccctatctgttatttttaagggatcattcaccggtttgtctccaaaaggggaccttttcaattaaaaagaggtctcaactctcatgtttaatttgctattaaatattattgtaaatttgtaacaaacagctttagctttaagttgagggtctggtcattagtgaacatcccaggattcaatcgaggtttttgttttcagcttactatacatgaaggaatgaatgtcagaaagtttaattatatattcaacgatcgaatttcacttctttacctgtaaaaagctaaaacttgttatgctattttttttttccgattatattttgctacactgtcacttgttaacagtttaagtagttataagtattgtatatggtaatcttcaaataaagttatgaattcttgttttgtaaaaatatttgcttttaaatgagtctatcatattttaatcagattaactaacttatattcaaatactatatcataatcaaaatctaattaataatttatttttttagtttaagttatatgtattgcaacatatttttacacaataggaatttacccaatcatcgcatatattaattaaaagaatggtgtggtggttaaattaacgctaacaatagatataaattaaattatttatatattttctttaaaaacttaagcaaataaagaaatagtgagtccttttgacatcaatacactgcctagctactttataacgacaagacaaaataagatttgcaccaatataggcttgataataaactttacagtctatatcttatacggtgcagattgtcaatatatattattatctaaaaaaatactattttagagtctcctagtctacactaaagtggggggaaaaaagtctttaatttctaatgtgaattgaaaaagaaaaaggaaataaaaaaaggtagccatgtacaaaaaatctcagactaaaattaaattaaaggcgttttctactattttatcatatatcctagaaatcattcgatgctagatatcttttccatcgtaaattcgggttaggagacacttgaaggggcaatatattattatctaagtgctaattgagttatggaagagtgtgaatgaataacaaaatataaagagctagatgacctaaataacatagtaaggatctaattatttcgacaaatggtagactttgattcgtcttatgagacgcctgaagttaattaataattcattaacagattgatctcctctttacctcgatctattcttcagattgaattttttgacttgtacatctaattaattaaaagaggacaggaaactttatatatggagctaaagtctaaaagttcataataaaacaaacttaatgcttacacacacattgatatgcttcatgtatataaagtcctattgcacatacataaacattagtttggatctgcttagacttattctcttgcttatagttaattaaaaacagtgtatgcaactatacgagacaagtgagaagtttataaatacagaagagtggggaaatggggttggcgttggatatatacatcacatttgaccatcttattttcctcttttgatttgatgtgaatgtgatagtgtgagcatatgagcatatgataaggcataagggagggaaatggaaccagatgcgtgccacaaacttcgggcagaaagaaagggaaaaaaggaatgtgacgtgaaaacccactcagcaacacaatatatagccatagtcatagacatagctaggcgtgatgaggaacagcataagtttttttttttttttccttcttgttgttatagaaagaataaaaatccgcattattaaatttatactattatttatacattatgttttttattttattttatactatagttttaatattattatatctaaatggattcatgtatttaattaatatataatatagaagtattgttttttcttactactttttaaataccgaagaatttgcgttggagctgaacaatcaacaatagcagcgaacgaatctctcgtacgtgtcactctccggtcaaatgccggtgcccaatcgcatgacacgtgtaagaataaacctccaaaattacaaaaacaaaatgcttatagtcggaattcttgactaactccactcccttgttaacaacgtgactacgaccccccatgccacttcccttctctgtcaaaaactatctccaacaatgatagtaatgataatgtacatgaatacaaattatttatattcatttgtttatgtaataatacatattaattatttgtatttagaaatgtaataatatatactagctagaaggtattgtgccttgtcaacatacgaatgcaaggaccccggataatcaatcacgctatcatataagatcctaccaaaccaaaccatatacgtggagctcaaatgaacacaaaatgtaaatttgaggttgaggtttttattatttttctcttcttaaacattacaaagcaagccaaaaaccttctaataaaatacatagcattgttgccttcttatataacatcaattatcttttattatataaaaagagaaacatcttagcatgcaagcattattcaacttgttatttttctttctcttttgattagattcaaaacgatcaaataaattaataaaggagtgcttcaattaattgagaagtcgctatcaactatataggtaataaatctttcaaccaactgactaataattctcgaatcgattgccttttgaggattaaaatatttgcctcatgttaattattttatatacttttttacaccctttaaaatatgtcaaattgcataatatatgaacagaaaaaaaaataatgcaacttactatttttaagatttgaactcttaagcttaaagtcatgcgacgacaactttaacgttctcataagacaaaaaaaaattatacaagatatttttttcaacacaaattaaagtgtgtgtaaacaagtgatatatgtaaaatatgattagatgttgtttgagaatatacggtgtattactattaaatcgagaaacaagtgatataaacaattgttcctttatttattttgaaagaagaaaaattgatttgctttagaaaaaaaatgaaccacacactgactttagaaagattaagatagagaaacactccccaattagctccaaacactaaagtgaggtgcaaaagtagaagggaataaaagcaagaagaaaaacaaagttctaaaccaaaagctcactttcccataacaagcaaccacatcgaatttaagtcttagctgaaatatcattctcaaagctacctttattttttgatctggcccttcctcctccaaccttctccttctcccattctcccatctcttcagtttctctcttccatggagaatgagaaggaccgtttttatgatccctttcattacaaccaccaccatgatcagcaactcaaccactcatcatcaagctttccattctttagggacaacaacaacaactcagcaccaattggctcacaattaaactttcaagggtttgatgatcataataacccttcttctcatcatcacaccactttcactgactgcttacatggttccatggattacaacaccctctcaagagcctttgacatgccttgttcatcttctgaagtgatatcctccaatattgatgaaaaccccaagaagcctagtgcaggaggagagtctgtgggggtcagtgggaaccaacaatcaacacctaattcatctgtgtcttcatcatccaatgaagctgaagcaatcatagaagaagactcaaccaagaaccagaaagataagcagccaaaagggtgtgaagaaggagatgaaaagcctaagaaagagtaggtttaaattaaaaattcttcttcttttgccctctttctttgtgatttcttatagatcaatggagggtaagaagattttaatttcctcatagactttctcttttttcttcttttaacaattcatgaataggatctgattatcttattaattattaactgttattttctagagggtatgtagaattttgaattttcttctttgaatgtactatttagtagtatttactaatgcaattatagtatgcccatatatcatttcgtgtcttttcagttgtttatgactttcagtgtctcttatgaaatgaattttgtcaatcttgtctctactctcttatactatatccagtgtgtgtaggtttttgtgtgtatgactaaaatggtggagagtgtggaacaattataggcacttaaccctaaaataattgttatcggtttggtgagtattatctgccatcttgcggtgaatttgactgatgttttggagcgtttcaggaacaaacccaaaaagaaagagaaaaagccaagagagcctcgctttgccttcttgactaaaagtgagatcgatcaccttgaagatggatacagatggagaaaatatggacagaaagcggtcaagaatagtccatacccaaggttaattattttttccaatttcgaaatttctaatctagttacttgtacattaatattaactttttaaggcaaaaatgatgagggctcttgtatttgtatcagccgaaaaaaatgattaagaagggttgtggaatattggggtgtgccaaaatcatcacatattgacacacaaagtcttctatttatttatttatttgttgccatatcgatgtaatgattcatattcttgtcatactaaggttgtgtaacagcttatttgtaagtacttattgaggcttgtttttgttattcactatctaatgatgaaattggagacataccacatatatattgtaaatatgaccataatattacacttacgtgtatatattcaacaataccaagaaattattaattcatcaagaaattatatacttctcatcaattaattgcacatttcacgtaagaatgtaacattgattctttatttataatgcaggagctattatagatgcacgagtcagaagtgcggtgtaaagaaaagggtggagagatcattccaggacccaacaatcgtgatcacaacatatgaagggcaacacaaccatcactgtccagcaacactaaggggcagtgctgcaagcatgttgtcatcaccttccttttttggttcctcttatatggcgtcaagcttaccccaagattttcttgctcagttgcttccaagttatagccaaaatgatcaccaaaatccaatgtttcaccaaaacctttcccataatctccatccccagcctcaacagcagcagcagttccaactccctcgtgactatggtttattgcaagacctactaccatcattccctggcaaacaagagccatgaacttaccaaaaacctagtgcatgttttgatttattttatctaggaaaaataatggttttatattttatgttactattagaaaaattaaaattagtaacggaatgatctatatatgttttaaaagaaatccgttactaaaatttagtgatcccgaaattaactggtgaaggaaaagtaattttctatcactaaatttgatcactgatttattaatttttagtagtatatatttctaggattttttttaaaataattatcttttcaagataaacagaattaaacatgcacttaacccatttctattagcatatggtggagcttgcagtgtattttcacattgtctatatataagtatgtgtagtaattaagcagtagcttccccttggttaattagctccttctctctttaagtcatatatatatgtacctagatttgtatggaaatgaaagacaggtctctatatggtaatggccggggatctaagagcattaaatgagtatttagaattactgcagatgaaactgatcttgattaatattcttaaatatagtttggtaaattttgtcaaaaatgtcagagatgggcggtgtgttttgcatttgagtactttgcaagttgcgaatatgtagtggagaaagatggttttgacaagacgattaacgtaccatatatgattgatctttctcagtgaaaggtacatatattgataggactacttagtgaaggtttcttggatcactagctaacacagttaaaagagtggtcaaggagtacgctactagaaatagaagttttcaatataacacgatggtaacgtagctattgattaattcctatttatggtccttatttttttgcattgataatttgatatatatgtcaatcattttacagtttttatatatatttcaaattatggggggattaatgaagaactatataggtacgtggaattaagaccgtgtatatatatatttcgacgtttcagttatagtgtatgtgcttgcgtgtgtaactatacttttggttgtggataaatacctaacttttaagattgatatgatcttaagctaccgttttattatttattatcttcttttttctgttttgtcgtgaaaccaaatggaggaatcaatatagctccagatgattcaaatgcaagctgaaattaattagcaataaatctttaccaactaaaccatttgtatatcagggtctactagttcgaaatgaagttatttaaaattaatgatctattttgctttaagaattataataaacaaatttttagaaattaattcaaggtctcttttatttgattattttaaaaaagaagaagcaatggtatcatatcattcttttgcttattattagatccccagatgatttaaaaatagaaaagaatgaaagaaaaggaattggaggttttatttctccattctttccttcaaataacctattttaattcgcccttaaaactagggtgaaagtgggaactgaattttttttaatagattaattaataagtacaataattctgtttcaaatgagtttccttttgttaattgccttattagtctttcaaaggaaagtaattttattctgttcgttttaccctttagtacatccataattgttattcatatattttaaaaatccaaacatatcatgaaaattctttattatacttaagaaatttagacaatttaaaataatatccatgccgtgccatattcataaatgaacactttgaaattgtaatttacatatttttttcctttttaaaaaaaatattataccaatatagatcataatatcataataattagataaattataatttttttggctcctttttaaaatattaattttctctgtatttatgttgtagtgtagttttaacttgtgtgcatgtgtactttcgaggttatacatactaagactgtcttttctatttgatttagactttcagtattcataattcactttaacttatttgaatttagtcagatgattcactgaaaaggacaattttttcgaaattttacttaaacttaaacctaaactagcacagttaataggctatattaacactctctatgttaaggctttttttttttttaatatactttttaaaaagagttgagataagtatacaaattcttattattgtgtaaatatgacattctaattaaaaccctctttctttatcaacatggcgaaatggtatgtacctcttctctccatgccagccatatatatgataattaaagtaatacgaagacaataattaaaaaataagcgcaaataaaccaagaaaaatatatacaacgaaaaaaaaaagcaagaaagtgagacaatttttcttcttgattaagaacaatatgttgcaggcatcttctcgaatctcgtttctcgatttgtttgttttgtcattgttgcaaaattgatgctctaaactttcaatattcaggagcattatcattttagaattccaaaactaatactattggattaattttcctgtttaaaaaaaacttgattcacgagctttaaattttttttatcattgattcgcgagctttatactaatacgagtatatacgaccaacctatgaattcgatacaagtaggcatgagaatgaaatccgtatttgtgggtatatgcttgaacttattttgactttgataagaaatacttgaattgattgggtatgactttgggtttggagattatttggcttttctaattggggtcggggtcggggatgaaatgtcattatcccgcccctagtcatagatgatgaaattattaaaattctcttttattactttagtttaggattttcaatttttcgttcactcgtttagattccaagttacaacacacaggtcatttatctttttaaaacttataaattgttatttactatttgtagtttaaattttaaaaaaatttaaaatataggtggatctttggtcagtagcattcctcaacatttgcaagatcaatagatattattgttgattagtaaagtaataactatacttatttactaatgtgatgttcgattttaagatttgaaagaaaatctaaatatatgatgtttgattttataaatatcggtccagaaagaaatgttgatggcatctttggtgaagttggtggttattttgatgatgaagattgttttcattttctaattatttataatttggtgtaatttgaactaatgaatattgggttagtgtctataactttgagttatgttatttaatatttggtgtattttgtttaccttaaaaaacaatagaatcaaggaagataaatgtattaatcttaattttatttattacttgttaattttattttagaatttttatataatataatatttttttgttgacgatttttgtagacaaatgtattacaataaatttattgatataaatagttaaaaataaatgtgtaacaattaatttatttttttctaaaatcagatttttaatataattttattaagtaatgaaataataaatttcaacccgtataaattaagatatgttgaagagtcgagattgaagattaaggccctgcctgtccatcctcgtttagcccgttgtcatgtttagatacaaactcgaatttgtgattgaaatatattagctgaaattatgtatatattggactagaataaatattgctgtgacatttgcaaaataactttcttttttctacttcattttttatctatttctttattcctttttcatcatattgtttctcagtctctttcttctcttcccttcttttcatctgatctcatacactataaaatgaggtttagttacccttaacttttccatgttcattattgaacaattatttgacgtttaccaattactttcacaattaattgtatcctgtttaattgattacgatgaattaatgataatccaactagccatacagctatccaagttcagaattttataagaaaaaaataatgcatccataaaatcattcactggttctaacttataaatgtatactagtatatgactataatgggcatattttatttatttattttctacttaaaaattaaatacgcaattttttttttttttgtgtgtaactattcaaacaccgggcccctaaaatcttaaatgcatgttttccgtagatcaaatcatacttaaaaaggaaaaagcaagttgcttaaaatttcagtcctttcataatcatatttgcctagcaagttgtctcgctcttatctttttgagatgagttacggtgttgattatttttctgcgatgttgtactaatttgttattatttgaacataaaaaaatttaatattagatctattattatctataattatttttatcttatttgtgtacatgtattctaaaaatgcaccctaaattaaaaggacattttttgtcattacaaatttgtattcaaaagacaagacaataaagtcttgatgatgcttacaacgcttcaataaagttatgggtaatttttatatatggaatttatttttaatagtatatatcatttcttaattagttacgtataattatattattgtaaaatttaaaatagtaatctcaaaaagcaatctttagcaatcttttagtgtaaccatatagtatttttttctatattgtacaaagctttacattataattttcaaagttcccttttttatccatatatttaatatacatgagaacttattaatttctattgtattttaattaaaaaatacattaatttctttactaataagtaatatcttaaagtactgaacattaaaaaaaaaacttaaaatacaatagaatgttgatttgaaatttgacacacgggggggtgttatatggcatacaaagtcaaagcaggtggagctaacggggctgactatagctgagggctgctccaaggtttaaaacattttaatatataaacattaaaaatataaaaaaaaatgatataatttactgttaatttcatttcgataattgacaactttgaaaaaatgaggaaaaaaattctaaatgatcacgagacaaataaaaagtgaaaaaactgatttatttttttcccacacaacttttgtagatcgcagaagtccaaatcattatggctaaaaattcggtttaccataattaacggaactaattaacaaactttgtaccatatccaaaccgtcttaattaattccatgaatgaatcattgagtgcctccattattgatttatcgtttgctctgccgccatagaagctttttaataagcttcacctttctcgcgacaaaatttgaatccttaacagtttctcagtctcgtgtgcttttagtttatcctaaatttatcaacgattagtcaacacaacattactatctcaacatcaaaatatttgctactttaaaaaatcaagatcaattatttattctaatatatcttcatttattttttagtatagattatatgtatcttttattaaaataaattaattttgttcgagttaaatagaatattatacacaatattttttaaaattttttaacacatacatatccaaaaatatattcatttattattattttacgtgaaattaagaagtccctaaaactactttatagctttcacattttttctccctcacacatttaagatatatgttatcattaaaatgcaattttatttaatacttatatgtaaggaataaattgcattttaacgatactgtattcagggacctatttataataaaagacgaatgaggaagacaaaagttattttgagggactctttttaatttattaacaaatagagactaacttgagattgtagttcactttgaagatacctagctattgaaaaatgaaggcggattaaccagggttaatttacaaataaagtattaaataatttgaaatatttcaccaaattgagacaatcaatactaaaaaaactctattttaattaaacaatgtcacatatacttttccgatttattaacattacataagatactgcgataatagtaacaatgatactggtattgtagtgtctcacatggacactacataagtacatagcattgataaatcaatatttcttttaaatattatttgacactttattagagttttccagtgttttctaccacaatttgataaaatatttcaaaagagatatacttttataattggtttgtaaaattaaccccttttaaccagttgtccttgtccaacttgtttacaacaccggcttttcatttgtctacacatagtcacatacggatacaaacaaagttgttgcccaataaaagtttgagtgacatgcaaggtatatctttatacaataagggaagtgtttcattaatgtgggacagtaaaaattatcctattttgtagaaataatttcattattgaagtagtatctcatgtaagattttatttttaatctttttatgaataaaaaacatgttaaaaaaatccaaataaacttacaatgcagttaaagttttttaaaatttataaatgattgtgaaaattttaaaattaattcattataaaaataaaattttaatccctcgagtaaattatattattttcctactaaatccttttagttatttgtacattagatttctttatcatgtcataaatgttaagtgtctaagaattttagtaataattattttttattaaaaaatttaaccgatcaactctaataaagtctcatatctcaattatatttttcactttaaaaaaatttaaactcaatatcttggttaactaagaatctaagtctaatttcatcataccaacgaaataatattagtgaatagtaatatttttaaacattaaatatatagagttattttttatttaatactttcatttataaagtattaaaaatatttgttatggtatataacattagccttgaaaaaaatttatcaaaattatcagttgacgtggaattagacatgcagacagaagaagtgttgcatctatctggcaaaagagtaggagaactagagaaatattgaagcagcaacgacaatctagcaaagtccctctacttttgatatttgaatcgattccgtggttgaaaaagtgacatgcttgtggctattgcttattgaaatagacttgttttgtctgacttgcaagttccaacctcaaagcaatgccttaaaacggcaattttccatcacattccaattgcataatcaacgtgacttgaatatttccaacttgttaaagcaaaagtaagagtagcagaatgtggatttacattttttaattccatgttagaactagggtccaaccaagctaatttataagaaacatctggttataagctaatgtatagaaaattaatttgcttaatgagaagtgagggaaaggaaagacttatagagtgattgtatacacccaaatgttgatactggacatgatcacacgaacaattttttgttgtgatcatgttacatactcttcaaacaacatttgaaataattatactcgttaatatggaaactagcatagatttatactactctattttagaagtccaaatactcagtagtatgcttgtaataaatatataaaattatgtgaaaaacggttatgtttgatagagagaaaggaaatagagggagtataaacaagtaaataataaaagaaaagagaaatatataagaaatagagtataacaaaattatagttattttatttgagaaaaatagaagggaaattgagtaaaaataagataaagttgttaggtatgaaagtaggaaaagaaaagaaatttaataatttttaaatatttaaatatttttttgtcaaatttagtctttgtaaaaaaattgttcatttttaattattgtaaattttaatttttttttaattttgattccttgtaaaatatattatttatttttagtttatatatatatatatatattttaatcttaatctatgtaagcgcaaacttatggaaattaaaattttgaaatcttaaatggactgaaattataaaaaaaaaagcataaacttctaagaattaaaaataaaataaaaacttctaaataccaaaattaaaaaataataacttacttaaatcaaaaacatatttaaatctttctaaaatatgtcattttacacttacacaaagaaaatgtattatttttttttttattgttggccaacataaacgttatgttgaatacacgagtgattatgttggagatcgaacactggagcttgtgaggaagaagaagacaccaacaacacgagatggaaagctagagtaaaagaggaagaagaagaagacatgaggactgtagggtcagtttttgtaaacgaagatagttttattatcagtgcaatgcacggactttttttttaactactttttttaattgaaatttaatttatgacatctaatctaattaaatgaaaactaattactctagagaaatttaaaattttattagttaaataaaaatttaattaaattagttaagtcagaatatagtaattaagaggataatattttaattttaaattattataataataaaacgtaatttcttccgagtaattcaaactttaagctaataattaaggtaaattttttattttgagttaagtaaaaaagttttttcatactttatagaaaagattaaactttcttacttttttaggataaatattcaatttagtctgataaattaatttttaaaaaataaaaaatttaaaggaacaatatcaaacattttttgttgtgatggtgtttcattactttttttcaagtcacacaagatatctactttctaatattttaaaaaagggtaaatagttattttcatcattgcgtagaatgttgacaaattcgtatccgaaagatgaaaattcaaattttagtatataaaagtaaaaaaatatgacaaatttattcttatgttaacttatgctcgttataattaatgaaagatcttagtgatgcatttaaggataaatttttctgtgttttacacattcaggggatgaaaatgactatttaatcaaaatataatttaatttttatcttttatccttttttaattgttacaaacagaacattataataagtatttaaaaaaataggaaaataaacataagttagaataaacataataataaatataatattaattaataaacataatttatctattattctaaaatttctaatgtaacattatcttacctaaaatataataatcaaataaaattacataattattaagttaatcattataaaaaaatgagattcaatttgattttgtcactgtctatgcctaatataatcacaatagaaatatcataacaacaaattttcgtcttttaaaaataaatttatcaacactctacacttttaaagataaaaatgactatttaccctttaaaaaaaaaattgaatgtcaaacctcgtcgttcttcccattttccttctcaacggtgccccccacactattcacccttctgtttatgttttctctcacgcttccccaccgttcacccttttcccttctgttttctctcaccttccccaccccaccctccctccacgaatcccactgccaccatctgctccctccgccccaaacccccaccttcacctcccctcgtcgcgaaccccacccctaccctccgctacacaacaaaccctcaccctctcctccctccgacactaccctcccacactctcctcccttcccttcgctaccaccatctttattctcatcaacaacatgtagagacagatatggtgctcataaaattagatttgtctttttttttttctttctaattttttatttcatttgtactggttctattgttcatctcttttcttccctttccttcgacgtggtaattgattcccgtgggtttctgctgggcaaagtgacaatttttttttttttttttttaggaaacagtgcggatcttggtgattcttgtggaagaaccagatttccagagatctgattgccaactccaataatgaattttaaaaagatcagatcttgaagttaatatttccttctaagaatcactattggatatgtccttacaatttcaaatttcaaattgcctctgcaatgtgcctcttccatactccatagtctaccaaagagcttgttgtcaaagttaaggcaaaaaagtagcgttttgtgttttccaatacaaagaaatgtttttttctcataaaaagattgtgagatattgcaatatttggacttcaccccgtaaatgagtctgtcgttgatttggaccataaagaattcggtacactttctgattaatgtttttgtttgtaacaaattgttaacaaacttaaaactttttaattgatattctgaattcgaattaagggaaaactgaaacttcaacatacccaattgtcttacacgtggcctgtttctattttttaataatataatttgaattttattaccttaaaaagacaatattttaaaaatagttatggtagttaggattgtagtttaacttttttgcattttatatatgatcttcattttgttcatacctattaatagttgcctcaagtttttcacttaaaacttctatgtagtgagtggaagttaatgactatggactccaccaatagttttttttttaaatatttctcgtatatttcacgtgtaccaatcgagggaagtcgtatataataaccctttttgcaaaaagaaataaaaatttaaatttataaaattcggtcgcaaaagccttagtgacggatttagcgacggagtttggcgccaggagcgctacaggtgctggaagttggcgccaggagcgccacagatgctggattttggcgccatcagcgccaaagtggcgccaggagcgtggcaagtcggtgctgaccattataaatagaaagctcgctatttctggagagaaacactgtttctcttcttcctcagagctccctccaccatttttgagtgcctaagcttcctagaaccttgtttgctagcccaaatcacttccattagccattgaacttgtgaggaacacctagaaagctaaaatcattcatccaaaccccttgaaaccttgagctgagagattcctttttcagaggaattgtggaacttgagctaggcaaggaactacggagattcaagaacattggggctaggagaagtagttcagaagtcttccttgccaattctgaggtaagaatctcgagtttctccggttaaattttgatttgggggtgtcctatgaatagtgatccatctgagttggggctagaattagtccagggtcctgtagagaaacttgcttagaattgtgtagtgatgaaggattagctttcagaattggatttggtgaactttgattcttggctctgcttatgaatgagtgacttgtgctgagtcactagctgatggttatatgacatgcaagagccttagaatgtgactgtgagatgcctgagaggctacatgaacgttgccttgagtaaggcatagaccattctagctatatttaaattctgagatattgaactgcacagagtttagagctctctatgttggcttacattgagtctggagagtgactctaagccttgatggagctgtgagctcatgatatgtgaactgtatagagtctgtgtggactcaggtactttgattgagccgatgagagctttgagctgatggtttgtggcttgtgtggaatctgtgatgaccctaaagcgttgtattaagctgtgctggacctagaagggtctgtgagagcctagtgtgtgctgggctatgatgaaccctaagttagaggacttttgattatgttatgtttgctggattgcttgaattgatgttgatatgtgtatatgtgcctggattagggcttgacaccgagggtgtcagtggcgggtgccacgaatcagggagagaactgcagagctcggctttgccaggtaagttcttggtccctggagatgatttctcgcttgtttgtgccccaccacactccgggaggagtgatggttacattcatgatgcatgcatttggttgttgcatcctcataatgatatgcatgtgcatctatgcttgaaaaatgtatgatgcctgttattagatcttctggccagtaagatggatatggacctccctaggagacggctattcctcctagttggtttgctcttggttgatgatatcccaggggatcgatgatccctcaagacgaaggggataggagacgggttcaaggacatccttctattctcagatgagataggagacgggtcaagaacatccttctattctcggaggtaccatatacgtgcgtctatgcataaggggtagctcccaatgggatggcacgggtgtgagatccggtctcacactgaggttaggcgttgatgtttatccgccatacatagagcaagatgactttctcatattgttatgaaggccgggaggccgggcagggtgaccaatttgattgtgaccgcttgatgtttgtgtcatggagagtgggccagggtggaggagatacctccccggaccttgagcttactgagatgtgtatctcaccccgtgtggggcttatatgttttcaggtgactcttctgacagaggagagcagtcttagggcaggaggccctagcagagacattgcatgcatggatagagatagcagaaagagagctagatagctcattttgattggatgtgattggatgcttgttagtaccctgtagagggctgtagggcgtgtttgcccatctgatatattgtatatgtttatataccctcgtgtgagggaggacattcttttgtatcaccacatgtatggtgtggaaattgatgtatatatttgtatagaacttggttatgtaatataaatgtttttcctcctgagtatatatctgtgaaatggtttggttatctgcctatgatgatgagtgataaactggaccagcaggggcatgtactgtattgatatactatctgatgagtgtgtgtgtgctgtgttatacatcccatacataatgtaatcaagaaatacgattcaatcgctttcgtatagttttcaaataacgttttaagcgcgattctgatattataaatgttaatacaccgggtgcacacggggtgttacatcgtacacttctttgcatttctatccccttcacttcttttcttaaatatttcacatgtactagacagagtcttactaatgaaaattgtatgtacaattaattagcatgtgttgcttacatgcagcttaattattcgtagatttctatattatctctgaagttaataaatagtagctgatagcttccatgtcttaaaaaaaatagatgcgtttttttcttttgttcctagctaccatgtttccaaacatacttaacattgcttgtatataagtagtaaatgtatgtaatttataaagcctatgttaacatataagtagtattaatttaggatttttgaccataaaagggtaaaaaaaaatcagtaattactatatgagaatagttttaaaattatttaccatttgagagtaagtcgtgccagaaagtacgacttctaaatcaaaagtcgtaccacctgttaagactttaatatttttcatttttttaaagtgaagtcgtaactttacttacgacttcattgtgcatattttttttttacgttcaaaagtcgtaaatatatttatgacttttaaactgaattttttatatttttatatttttttttctttacattcaaaagttgttctagtttaactattttctttttcttttttatagctatatatatatattatttttccttaagtatatatatatatgtttatttttgttttttttttaattttatattaaatatatggatatatattaaatattttataattgcttttatttattattttcatttgtttcattgtgaagttttttattggtcttgagtttttttttaattaattttaaaaatagataaaaagtagtttaattttattgtttaaaaatgcaagtaattttattttttgtaaaactatttaatattttgtaaatattttaagttattttattaagtattttagtaatttatgttataattactttggatcacatttaatattttaattaattttgtaaatttttgtagtaatgttaaaatttaaatttttagagatttattgttggatgaaaatattttgataataattttaacttgtaaaatatgaaataacatatatttattttgatttttctaattaaatatgttgattttgttaatgattttttacaaatgtaattatttatactttttttaacactatcatcgtaactatttgggatatattttaaaaatattatcatttaatatttaagatttaaaagaaaagattggaatatacttggggtgcaattagcaaattttattttttagtaaaaaacttataaaaaacagtggaggaatgtatttagtaatatttaatgtaggcgactttaaagtcgtgagcaatatgacgacttaaaagtcgtttggggttcaaaaagcaaaaaataaaaacagtacgactttaaagtcgtaaatatatatacgactttaaagtcgcgtatatatatttacgactattgagagtaaactaaatagtaaaaaaattgtagtttgaaagtcctaaatatatttacgattttaaattcgtaaacacagttacaacttttaaacgtaaaaaaaaaaaaatacacacagtaaaatcgtaaataaagttacgacttcacttttaaaaaatgaaaaatataaatgtcgggacaggtggtacgatttctgatttaaaagtcgtaccacctgacacaacttaccccaaatggtaaataattttaaaactatggtaattactgatattttttaccatttatagtcaaaaagtcattaatttaaatacatgcagtaaataacacgtttatgaaaggaaggaaggagaagtcaaaagctgtggcaaatatgggccaacttgccgcattccccatggagcttgtaaagtggtacgtagcagaagagaaagatagttatcaagaagcctagatgctagtccgtgaaaataggtctactttatcagaatattgaataattatgtattccacttccaccgtttgaagccttcaacttgaatcatttgtttgcctgtctgccaaataagtgcttcctcaagaaactcccatgtttagattctcttttcgtttgggtgaaataagagaatcaacaaaggattgaaataacaaatgcaaatttaaaagtttttcccttctcattatttcactaagatccacaaaatttttggtacaatttaatttatttgtgaaagataagattcctttatgacactagcatcaatggaatggaacaaaaattatgttaaaaagaatcaaaagataatcataactagattagccattcacaattttagtgcatgaaccaacaatgtgcttatgtgctgtgaaggaaagcaaccacttttacaaattactggggtactgcatcattcggtgctggccatcttgaaacgaaaacttaattaactatactgttagaaatgaaaaaaaaattaatgcccatttcttgtcagataatttgtgcaagttggaatttgaaccatggggacattgcttctacacgtataataagcacataagtgactgtagagacaaaccttagctatatctaaccgtaaaagcccaataatttggagggggagagaagcagcagtagtaatgataaggaatctaattgttgagaaaataacacaaataagccaaaatactgcataagaacatctccacaagctatttaacttcttaatttatatcagccctattaccacataagttttaaaattttcaatgtgcaaggctgtgtttggaaagttgttacacatttacactgctgtccaacagaccttttacacaattaggccttggattggcattatgttgaacttaacagatatacaaacacactaaaactttaaaaacttaaaacaaatctcacaagttatttcatatgtttatattattttaataagtcacacaagaaattattcttttaatgttacatttttttttaaaatacaaaattcttacatgagttctacattttcaccactttgtaaaaatcattaggtatcaatatgttaaataccttaaaatagattagtaaaacactaaaaatatctctataaaaaaacaacttttatttaccctttcaaaaggaaaatattgttagaacgaacaagatatagatgaattatccatatacaaaatcacaattattgactctaatggtgaaattgtataaaaactgattcttaagtctaagaatctcataaggaactcccatttaagatgcttgaaaaatatattgtcacttgacatggaaatcgaagccaagtattcgtttttactatcgccactctccagcagcgagtgactatgtgaggatatgataaagtcaaggaagttaagaaagaaaatcaacaatcatgtaagaagataggccccgtagcatctgtaaaacactaacactcacagcacccatactgattctaccctctttgcaaggctagctagtgtatcatatcttcaatggcaaccattcaattaaaaacaaaaacaaaacaaaacaaaaccttcattatccaaacgggctcactctgatctgattctatcctcagatgaaacaaaattttcttaataaggtcacaaagttggagatatttcaatatggtatagataagttactatatataacgtgtataacgggaattgtacatgcaggctaagtcatggggttgtcaatcctatccttcaacgtggctttcagaaatttccatcttttcagcatcagatggaccagaaatatccttcacggtttcaatttccatgctggcagtgccactctttcttttccttctatcctgaaagtgattattatcaatcagttgtctaccttacgttttagtgttttgttgtcaacatataatacttcaatatttagtatataagcacccaaaaacatgcatacaaaagaggaccatgctctttataatataatgcatcagaatgctaagtaggtagaattaaacagcatactcccactaatatgttatgataaacacaaaacattatgctttgtttgtttgtttgtttttgagctatactgaggtgctaattaagtaaatagaaattgtgtagcctgaagaatatcaaatttttgggtttaatatggcgacttttggttgtagttcttgaaaaaaaaaatattagttttagtttttatgttaaaagttttgaaaatagtctctatcaccatttattgatttattgatgacttaacatgcatctaaatatgtcatgtcacatgccatcttagaatgttcattaatgtgacctatatgccatattatgaggactaaaaccaacaattattatttgtaggaaacagaaacatattttacccccaatttttttcctgagttcatccaatattttgttctttctagttggtggtagcctggtaggttagccaatacatgtacgaaggagaataatgataagaatgcacacaaggtagaaaatatgcaaaattgtgatataagactcaagatcaaagttattaactaatcagtagaacttatgtatgagaagacaagatattgaagggaacctctcgaagtggatattcgtcagcttcaagcatcctcacaacttgactcattttgggcctcttttcagcatcaggatctatgcacctaagtgcaaccaaaagagtgcgcttcaaagcacgcagtggtggtttaacttcaaggcttgagtccactacttcttcagctctccgtgtccccaccatcgttttgagccattcaactagattaacctgtcataatgaagataaacaatatctcatcagctatttgaagggcagtgatcacttacggtggaaagcatggttagaactggcaagcagacagagttcataaaaattagccacctcattagcaggacgcgcatagtctacagggtcccttccagtagctgcttccagcaagaggacaccaaagctgtaaatgtcactcttctcatttaacaaaccactgttagcatattctggtgccacataactgaaatccaaaacaaaagtgagttcctaagtgtacaaatcctttaagtaaaaaataaggaaagagataataaattttctgtatacccaaacgttcccattactctagtggttatgtgactttcgcctgaatccaaaagtttggccaaaccaaaatcagaaacctttgcattgaattcatcatcaatcaatatgttgctagactttatatcccggtgaataacttttggttctattgcttcatgtaaataagcaagcctgccaccagtcacagtacaatagagggttaatcgggagaacaaggtccatcatcgaatcttccataaaaataattttgtaactaattaagaagtaaaatatttaaactacaataggtcaaatgttcactaagttgtttgaactaatggagtgaaatgaaatggaatccattccattccacccaaaactgctccttttcttccccccaatttgggggtactgggtgtaaccagtttttctaattcaattccattccatcataaaatattaaaacaatgcaacggtaaatttatttcattccatcacattccacccattgttagtaatttaaatccaaatatggcctaagatagtcagtggtcccatgggcagagtgcatattgttgtttagactagaaacctaatgggcttaaatatactgcaaactatatgagaatataaagtctataacaaaatattatcaagaaacataaatacatttaataacatttatgatatattttgacacgcacaaaacactaatagtaataacattaattaaaggaacacatttttacaatcaaaattcagagatgagagatttatgataattataccgagtgatttggcaccagactatacaaatgattaccatggtatatattttaagttgcaccctgaacttacgctttggcagtgccaagtataactttcatgcgggcctcccaggtaagtgtcccatattggtgcatgtctccatgtaaccattgttctaagttaccattgttcacatattcatacacaagcagcctgaatatcaatcaggaagcacattcattatgacagataaagagacataacatagagaaaagcttatgtcctattttggactaagtagaatatgactatcataaacccaaagctggcactattattgagaatgaatttgtgaaatataatacaaagtgtagtggatactaatgtaggaaaacaaagattttttttttttttttttacctatgaactccttctacacaatatccaagaaggcgtacaagatgcttatgtctaacatggcctatagcctccacttcaaccctgaattctttctcagcttggcccctaggaattcaatgcagaactcaattacataacaagattaaaaagaagtaattgtttatgtgtagtgtcagaaagtggcagaagaaaaaaaattaaagggtacaccaataataaataaatatccttacaggttgttaagaagcttcttcactgccacctcagttccattaatcagtctgcccctgtaaacaatcccatatccaccctcgccaatgatgttctcacttgagaaacgattggttgccatttccagatctctaagtgtaaaccagtggccccacccaagatgagaaaattctggcaagccaactaaaggagaggcagtgaccagccctccatgtgacaacgtagattgcttcttaacattcccagagcttccttcttcggctgacattgaactcaatcctctctcatgatgataaattgagctgcactgactgatattatcaggatcaccagatttgctatttcccaaacgaactgatacattatctgaattgttgtcacttgccttgtcatgaacaggaataaccacattttctggttgaacatgagaactctgcaccccaaccttgtcaacatcgatatcttttgagaaatttggtatttgggatacagaatacttgtccagagatctcctagactttctccgaaacattgcccatatcgataatatacacaaaatcagcactataaatgcaccgacacctatcccaatcaaaacccatcgtttcaaacccaaaaatgacgtcttctttgacaattccatattcaaagaactgttggatgacataattggttgcaccgagtcaatcaatatcgtccccacaagttcttcagctggtagaaccaagacattcccactcaagtacaggattcaagttaagtactccccttactcaagacttcgaaacacacatctgaacatactaatttacagccaacatttcagttcttgcaacaatgccataaacaacaaccaaagcaagagtttaacaaatcactaattgcatcttaatcatgatttaaggtaatctcagactacaaaatttcctgtaagctaaattagaagatgaaagactcccatctcaggctttattggcaatggcatacaataaaacataatccaattaataaaagaagcagcatatataattcagcagtttcaaaaccaacacaatcaaaaaggcatgatgaatgaattcacagttcatttgggaaagtaaaataacctgatgcatgttgataagcacaacaatttctaatgaaaaaaagaaaggaaaccaggaaagtatcacttatgatccaagcaaacaaaagagaaagtgaaatgtatattatccaaaaagtgattgagaaagacaaagcatttacctttgtggtgatccaaggtagctagacttctgaatcctctacccaaagaagcaacaggtttcacacctcatttggaaccgacaagagacttaatgtgcaaagaatacctgaggatgagcaacacacataccctacagcaaaatccagatgctgcaaaagatgtagtggcacaacagtaggtaacaagtgggccacacttaaacaaaaaaataaaatgtaaaaaatattaatataagaaaatggaagggaatgccagacaaaaatcttattttgatgggaaaataaagaggtagagagagaatggttgtattttactaattagagaagagaaagagtaaatgtggtaaaaatggttggtgggtattgtgttgtgtctgagggcaggaccagaccaagctggaaaggaagcttggtttgcaatgaaggaaagcagagacagagagagagagagagagagagagagagagagagagagagagagagagagagagaaacagtaaagggaaagcaaatgtgaaatgaataggtatgtatggtgtttatggatggctggtagaaagaaagaaagaaaaaaaaatggaaaattgtaatgagtaaggaagaaaggtaaagtgaagagagaggggagagagagtcaacctcaatccaacagacgagctgagcaccaaatctaggcttcctctgatgtcatgtctgttcaccaaactatcctatttgtgtgaaagggaaaaatcttatgcaaatcttgaaacttggcaccatgctactatgcttcccctcacatgccatttcaatttgctttgggttttggtttttgaacatcccaaaattaactctatgttttgaacggatcatagaaaaccaagatggaaagaaaatcttaaaatcaaaataataataaaaagaatattagaaattaatttttaaattaaataaaatatcattattcaaagaaaattgtatttttaatactgtataaattattgaatgaattattctatatgtatcacatataaaaaaaatatttttcctagtagagcttgatatgttcaatcctagactaattatttcatattattgagagagagagagggaaaaattacaacatttgaatatctagtaagaaataacattttttaaaattatgggaaaaaaaccagcaaatataaacacaaaaacatggtggagggaaaaaagtgaagtaataaaattgcattatttcttaatcaactcaaatttagtcaaataaggttaagaaaataaagatcaaccactttatttaagaaaaaaaactttttttttatataaagttgtaaaccaaccaatagcatatataatttattattattattattattattattataagaaattaattctctaccagtaatggctaaatttccctttcagattagattaaatgggtcaaagtcagaagcttttagttgccaacttattgaaaatacatatattaggcgaatataacttgctgaaaggtatgtttttttgcccttaatagataatggcatgccttgatgtttaactatgccccgcatgatataaaattcgggtgactatagtgagagaggtaattttgtcaatacgttttgactaagcttgatcttcagacctttcctgagagaaaatcgaaagcttgagttaaaaactgtgcattttctgagtatgggtttagagggccacaaaaagccaccaatggaggaagaaatagatactttgattcgaagcataattttttattaaagataatccggacaaaacctttgcacttttcctcactttttttttttaaaaataattactattagaattactatttttttattatctattattatatgagcttaaaattactattggctcaaactattgtcaaggtattcctttttatccacatttgaaagatattattttatatatatggttcaactcttgcattttttttccggtgtactcaactcttgcatatagggatttagtatttcaataataacttcatcaagtctaaattcatagggaacaacatttttatattaatataaaaatatatagtcaacaaatataaaatatccaaatgtataaagtagcaatttaatcaaatattataatttcacaaagataaaagtaattatttccccctgtgatagcgggaatgatgaggttttataattaacgatgtgaatcgaaaagatatattattcaattagtttaattgtgggccaaacatgtaatatatcaataaattgttataatttgaattctaacaatactattatttttttgaaagcaacatctgtgaattttctaatacagagtgcatagatagttcttaatcggataaaaaaagtaaattagttcaagtgatataaaaatttaaatatgttttttccctcaaatttgtatcattttattttttcctccatattaaaaattattttatttaattctccaattttgcaaaatactttttcatccctcttatataatagcatatattaaacgcattgttgatgtggctacttaatgacatccacgtcaacaatatacacattaaattaattaaataacatttttttaaattaagtatttttatatctctcaaatttacatcaagtttctatttgatctccaaatgtaaaaatatatatatacttcacattattacattaggattacggagtgaactctaatcaccaaaaattcagttcattaaataggaaagtctcattacataaatttctctgttttctcaaacacacataacaccgaggtaaatatataaaaagacaaattttaacggatgctgctacaattggagggttttgtcttataatacttcgggtgctaatgaaactattttagtaaaatttaactatctcaattctcgggtgattgcacaaaaatttcgagttcaatttattcgtattttagagaaattatatataacttcttattcgtattttagagaaattatatataacttcttgaagctctatcaagaaaaacattttgtaacaaagaaaagcatgatctagctacactttagccacatttaatatatgcattaggtaacaaatcatttacatcaattcattttttctttttgactgtggtggtaaataaatttaggaaaagattggtggaccaatcttctggttaacacctagagagaaaaagagaaaaaaaatatataaatatgagtatatataataagtgaaatgatccgataagaagaaaaaaaatacagaaaaataatagatattgatgaagtgtgtaatatattaaagtggccacatatgtgaagatattcacataccactctcataattttattacttgttttgagaagagagagcaaagaaaatgcacttaatatatagtacgtagcacttcagattcctccagatttggaaagttgcttcaaagcattagcaatgttttcatgtgttgtttcagtaatggatgcaacaagagggctctcatttgggacaatatcatctctttggtagcttcctggacctcttagtaactcttctgaacccttagacaccactcccttcatgattatggtcttgtgagttccagaaatcatctcctcataatccgtgtccccggtttctccaaggatgacgtacatgtttgcaacgttcaatctccaacgtacaaagagatacctaattaacatatttaagcaaataataaacattctgtttgtgattaggctaacttttgaaaaattgatttcaaattaaattgattctaaatataattgattttgaagtcgtatatttaagtttgggtgtttttattcttaaaaccaagtaataaaattttgtataaaatttcgaaataagattacttttaactaaaatcggttctagccatagaatcatgttgcgtttgatttgacattcctcgagagaaaactcgcacaaagaacatgcccatgatatttggaaactatctatcttagctttttatgttaagtgtgtgtgaaattgatgcaacttttaaaccaactagatcataacatgctatcaattcttcaacgtgaaattgaacacatgaacatttacttaaaatgcatgttaattgatactattttaatgtgattttggatgactcaacgtgaaatcaataatgtactcaatattacttgttttatattatgaattgattgaaaaaattagttagaaattaaggatgaagtgttaattacctgagtgcctgggctctagatgcaagaagaggaatcacatgcattctagatgaccccctgcagtacataggatgacaacgtagacctcgcatcctaagcttctgcctcaactcatcaactttttttgcctgaatttaatacacatgattatcatttatctcttagtgcctccagctagccattatgtaacttaatataatggtaaatgtcatgttgatttataccttactaagatcctttattttgtatgagatgcaatgtgcattgctggatttcagatcttcctcaatggggctgttcccatcaccattcataagtttccaaatggttttcttaagaccttcacacccccaacgatagtcaatatgtacctcataatctggatcaggcaaaagctttccttcttctgtattgatgccaggatagtaaacttgacttccactactgcaaattaaagcatcaaactcattcacttgaacattgcctgatgtaaggaactctactgtttctatcactggcatagcagttgataaagcaatccctgtaactctagcagtttgagggtctagttgcacagctttaattatcttttgcaccatctcaatcatgttcttctctggagctccattattgtcatacaaatcaagtgctataacaatcaacctacgccttctcctcaatagaggatatttgctagtgttagtgttagtgctagtgctagttacattgtcaagaagcatattgatatttccaccaccattaccatttgagccagaatctgtcttccttatcttgcttaggatgcgtttaacttggtcttgcatatctagaccagtgcctccacttgctgcagtcaagtcaccatcaattgagagcctaagggacatgtcgtgttcgtccttgagcgaatcgttgaaagactcttcttcttcaacagctttatcatcctctggattgttggtttgccattgtggatgcctcatccgacaggcagccgcccgggtcaagtaagtgcgacagtgttcaggccatgagaaaaggtgtatgttcttccaaccgttcttcctgcactcatgccacatgtttttctctgacaacaacttcaccaatgcatcagcaattgctatgtcatcatgaggatccacaagcaaaccattgttcagggcctaacatcacaattcaaaaggagctagacctaattaggtgttcatcctgtttgatttccaaaataaataaaacaagaaaaagcaaatatgggatgtacaattaatatccaaatcactacatactgcattttttttttggtttcctccttcggaaacaatcatatttgaggccgtgtcagatactaaatgtgagtaactctcctagtgggaattcaaatcttggtttacaattttttttccaatgctttgatgccatttgacaaataattcatgaacttcctagcatgcatcatgcaactgactatctaaacttaattcttaaattacccgatgaatgtccacaggtcccccatttttagtggccaccattggaagtccatgggcagctgcctgcatgagtttaagcacattcaataatcacttcagcatcaaaataaggataatattacaaaagtggctagttagttaaaaacctgcctcaattaaagtaaggccaaagggttccactaaagccggatttatgaaaacaccctgagagaaatttcaaactagttagctggccatcattgttatcacataagaagttagatctcaacatatactaaaacttcaataaattttatacctttgtttttgcagcaaatctgtatatctctggaacatcagattggttgtgatgttttgggtatgccacttgcccgtacaggtcatacttatcaatcaatttcaacactgttgtgagcacactagcattgccagaggacatttcatctatgtcatccctgtttcccattataagcgtctgtttgaaaacatattagtcctttttacaagttctcaaccatagtttccaccaagtattgagcagttgaattatgtcaacttacaagattagctaattctcttaagggacggcattctccaaaggcttttaacaaagtggttatgttctttttcggatctggccttgacaaggctaagatcataggtttatgaggatttgtgaagaaacgcatcacctgcacaaagttatcagttacaacttgacaaggctagtcattgactctggatttataaaggaactaaggaagaaaacaataagcaaaatgaatcaaatttctttcataagaaaacttcaataaaaaaaagttaaaatacataaagtgattttaacttataggagaaatttaattcattttaccttcttattttcttctcctataagtatttatgaagaactcaatgtaatccaagatatgtagacatgttagttactcacttctaaccagattgtaggtaaagcctttggtgaagactcatcaacaccacgagtaagctgtgtgagctccccatcaacttcagggccatcttcttgtgtcacaacattgctaaagtccataccaggcgggataacctacataagtttgaaccattagtacttcatacaacacgttatcttaaatttgagaatttaagacatgctaaggtgcataagaaaacaccaaataaagtaactgatataaccatcccttgaaaaagttggtacatagttgtttccttttccaaagaagtttcaccaaggtttaagaaataaaagactttcaaacattgagtgtgagtgtgtgaccctagttgcattcttaccgccatccttggcatgaatcggccatgacaattaacaccacgtctaactcgagctcgcaaaactttctcaagcttgacatcaaacccatcataaagtccccattgctcatcaatttcttgccttgtgctagtgataacaagttcagcagcatctagggaaagctcttctgcttctattctcctcattatcttatatgttgagttgatatcctccttcgattgacgcccttgcttaagaagctgttctagcttgtttcttccaagtgaatggccagtgagcaccattggcacattcaaggcacctgaaagaagagcagcactatctccagcatcggcataatgtccatgaataacgtatggccacacaggttgccccccactaacttgttcacccaatacttttgacatattgagaatgtgagctaaagccccatctacaaattcctgaatatagggccaaagaagttctttctgtagatatttttcacgtggaccaaagggtattcttatgatatatgcaccactgctctccccaatgttatcatcatcctcatctgtgcctgcacttagcatttctgtaggttctccgtagctccaatcaatttcaggagatgagatttggcgtgtgaagaggtctactctatacactcctggcatttttgctagtgcacgagcaagttctaccacatatttaatctggaaaaaacatattggttgaaattgaatcattgttgaacaccaattaaggctatgtttgataaaagttgggaatatgtttttgggaattccaattcatattcttgaattccaagacaaaaaatgagaaggaagattgattgttttgagagtataagtatttttaagctacttcaaccaagaaattattagataatttagaactatcacctatccatagttttgactaatctatgtgacatgtactcgaattttttcatttatgaaaaagaattaataacagttcattacttgtcatatacgtgaagattaataggacaatgatcatctcagaccatctaataatttctctcaccaactggcatcaaaacacacactaaatggaagggtcacagcttattcatgtagcaatgtctaatacctgtccaccagtatcagaatctcgaccaagctccatgttttctcctcgaaccaaaccatgcaaactgtcaaacgacaagggtcatagtcaaacaatcaatataccttagtaaaacacaatcaagaaatttggctaaacacatttattgaatgcaaaatgattgtgagaaagtgaagaattaatataccttaagaggacaatgtaaagtttcttttcctttttgtcatcagaccatacttccaagttggaaatctgcctctggaaatttttctttgatgtctcaatttgtatcatctccccaatgccatctcctttttccccttctgacaactcttcagacaggtcctctgttgcatccctgcgtccttgttctctctcccatcttctgtttgctaatctctgcagctcctccccttccaactacaagtagtgccccattaatttcactaacaatcactctggtatatgtgtatatatatatatatatatatacttcccccaaattcatcgaatgaaaaagcaaatacaacaaaaatgaaaatttacaatttaaaccaaacaacattttgcttggccactcgagattctattgcatagcattcaacaaaatcaaacaaataaacattaaaaaacttacgtgcacatgtacatatatattactatcaattctactttcaaatcaagtgttattgtcatgtttagtgttatttttttcttcattcctaacaagtattcttcttcagaaccaatcttgtttgttgtttgaagtattgtcagacactaaatgtaaacaactctccctgcagggttcgaaccttaggctttgtttggaagagggattttagaggggaagagagggaagagaaagatttaggtaaagacatctctttgtttgagagttttaatttttgagggaaaagatttgaggatttttaaaacttatctgaaatctgccaaagcctacaaattgtagttctcccaatttggaggtttttagaaggaaaagtaattaaaattattatcttacctcagctacatattcaaaaatatatttttaatatatttttaatatatttttacatttaaattatataattttcatatttaatatcttattaactctcaatttccctctcttaatatatttttaactctcaaacaaggaggaaggaacttccctcattttcctccctttttttcccctcttccccttgaatctctttccttcccttcctctccaaactcccaaacaaaaccttaggcaattagcactaaatgaaatatgattgttacctgtttcttcttgcgggcaagatgccaaattcgccagcacatgttctccaaccttgagctgcgttccctggtgttacgagtggcaaccaccttgatccatgtacggtgaaggtcagactcgtcaacactggacaccacttcttccacaaagtactttgtgggactaaaatgtgcactttctggtggagccactgctttttgcatttgctcatcaacggtgccagccccagttccagtggatagtatagcctcaaggtacccattaatccattcattgccagccattagaatatatatatatgcacacaaagtttcttttgtgttgttgtctatatatgtgtgtaacactagtgcagtgcagtgttgtcttcaaacacacttcaaaaccttagaacgtggggaatttcatgaattttacgtgggaattcattgacatggccgtccacgtgcctatgcaatgaagaggcagagtatgcgatagaattaaggtgcaagagattatttggttgtgttggaaagaagagtatgagtgggaattttattatgacatgttgaagaggaaagaaggagaaggaaatggaaatggagatgaagagaaccagaccacatggtaggtacggaatgatgagccccgcatattcttcattcgtttgttcttatttgtgtgtcttgccttgtcttgtgtggttcatgatatgcactcattaatattaattaataaactgaattttacgtgtgtcttattcattaaagaacaccaatcacaagattagtatgttttgataaagagtgtgttattgcttactaggatattaatactacttttatattgttttgttttgcggaggatttattacttattattataataattttatttcttgtatctatttctctcttttaaatcttaaataataaggaagtgttaattttttttttgtttctcaaggtcatattatatatctaacatatatatatatatatatacactttgtttttctcttctcatctctctttatcttgtgtgtttattgtaaaaaaattgatgtgtaaatcacattactccatgtataaacctgcctcttcctttgaactttttgcttcattgtagtttgcaatttttaaaattttattttaagattaaactattttctaaattttcaaaattgtaatatttgtcttaagtaagttagtaatatgtatgaatgtccactttgtagattgaatatggtgcatgcactagaaagaatgctttcaatattcttactttaacatcgatttttgataaaatcgatgttaacaaaagggcgataacattttttttataaataaactggttttgttaatatcagtttttaaaaaaatcgatgttaacgtgacgctcttaatatcgattttcaaaaatcaaagttaatgtagtgatattaacgtcgatttttcaaaaatcgatgttatcgtgacaatattaacattagttattaaaaaaattgatgttaacatgacgatgttaacactagttttataaaaaaccgatgttaatcgatttttgttaacatcggtttttaataaccgatgttggatttttactaaattaaaactcaagtgactaaatgtttttaccataacatcgtgcttactctttgctactttgtgctttcctacttctttgttctctctttctcttctccaagttcgcaaagaccgacaagaccaatcattttccacatcggttttataagtactattcaacaaaatcgatgttgtaagtactattcaacattggttttggcagaactgatgtagaaagtgtttatccacatcagttatttaaagaaccaatgttgtggtaaacttgacaacatcaattttcttgaaaatcaatgttgtcgtgtgcaacacaatatcgatttttagaaaaatcgatgttgtcaagtatatcataacattgtttttttaaatatcgaaattgatttttatatattttacattttttgatttatttcttattatacaacatgattttcttaaaaattaatgttgtatagtgtatcttaacatcactttttgaaaactgatgttaacatcgatgttgaaagtcgaaaacaaccaatttaaaagcttattttctagtagtaatccatatttcaaaattgattacttatccatgtcatactgatatatatggactatcaatatgttattataagagtgactgtgtatcaaaacttgaatattttatattctaacaattctatataaattaaaacatgtattaccataacttgagttataacatatttatttaaacttggctacacaatactttcctcataagttgtgtaagaaataatacaataatgataaaaatgcatatgaataacaaattaagaaaatataaagaaaaaaagaacagataaattaataaaatattgaaaatatattactataattacatttagcttaaacattataacatatatacagtaatatacttatatcctatttttttatgataaaaaaacatcgtatttacatatgatattcatttcttgtactcatatcccatacaacataataaagcaattaaaggttggtcaattataaagttaggtaatatgaattgagtgtgggattaaatttccacaattctttttcattctctctctctctctcttttttttatcggcttctttttcattctcttatatcctccctcttataagttctagtatcagcttttccttgaaaaaactaaacacaaaactacaggtcctcagcactcactagctagcaccattttttttggtatgtttcactatctatctttgtcatttctccatgctattgctgatatgcaacttatacaactccacttgcttcctgcaagataaagtcatcaacttggttatatacagattttaaagttatgcacaatcatctaatatatgttttatgctttgtcaatggagtttaattaccttaatttgttagatttgatatgtgaattattgtgaatcttttgataattaatttttatgattcttacggataaaaaatatggtttagactttaataaaattgatatcttatgtattttcaaacttattaaataaataaataaattaccaaaaaaactcattaaataaatgtgatgacgcattataacataaaattcatacttttgaacagttttatatatttaaaaatttgcctctgttgtctggcactcaccaaagcttatgatatgtttgaacaaaatggttaaaaatcaaggtgtcgcccatgtgtttgatgcgaaagtttgtggcaagtgagccatcatccctcaaagtggtaaccaccatcaaccaaactttatctcttctcttaacatatttcccttcattgttttagagctcttttacaaaatatgcgtttccgaaatagctagtaatgcattgaattgattgcaccaaattttagtttcgatacgattgatttcattggcacgtccctctcctttggcaatcagacaaagaaggtagctatttgggtgagagttggcaaaagcagacaaactagtgtttgtggtacttcgtcacacttatccttttgttttagactgattcactgaatcgattccaattgatatataaaaaaagaaacacgttgcttgttgtcttgcttcttctttgttatctttgataaaatttaggaaccgttcacgagtagtttaaagatattaattaaaaaattaaaaaaataaaagcatcattaaaacttaatgcataaagatgttaataatcttcaattttattacttttaataacaatttttcacttttattttttttacaagtgttctaattaacattctcctacacgtaacaatgagaattatgtgataaattttgtattcgtaaaattttaaaaaagaccaaaagccaaatgagagggttctccgagatggctcaatctagttacttgagatttttatggtcaaaaagattgaaaatttaaaccatcttgagacttttgtaaatcgttaaaaatatccatactctcgtcgaaaatttcatagcacatgctcaatgctctgcgtatcatatactacataattcattttatattttgtaaaaatttccatacattaaaataattgatattgtttatttccactattttcttttccttctttttcttttcttgtcgtaggattggcacatcctgtaaatacaaaaattagacagcccatatgtacccagaaataaaaatatagcccataacagcgagccacttattagggcagcccattcctgtaagtaaagttagcaattagagctacaacaaatacccaaacaaattgattactttactgatgtttagttgcttaagcagcacgtaatttgtaagattacagtaagaagaattaattataatattttgccaaattgattaccattttttttaagtacttaagctcaattaaattttgaggaattatgaattgtacctgtaaaaggcttgccaaacccttttcttctggcaccaatttgaccagtgaaacaattgaaggttagtccgttttcagattcatttgaacttcatttttcctttagttcactttaatttaagttactaagatgtttaacaattcatctactctactgaataaatcaaacaacataaacatgtaatgcttttgaggatggaaaaaatggaatgctcaatgacagtaacaactaacacagatgcacattatgaacatcaatcatgtcgtcatgtataaactaattaatagtattattattgctttgaccttttttttcaaaagaaaaaaacctcgatctaagactagtttttcttttcctatttatgtacttaagacatgtgaattgaaggtttacaaaaatacatgactgttacgtacatataataacaagacaaaaagaaaaactaaaaacatgagtcacacccacccacctggccttgcattagcaataataacattgttatttcatggaaattgaaaatctccccctacaccttgtccttcagcaccttggggcgggctaatggaaacccaaagcaaagaaagtgtgatcgcaatgagacctgaccatacaaacacaatagtgggtgtcttgcctctcctccccatcaacccttttgcaaaagggtacaaatgagcaagcacccagaaactgaagaatgcacctccaataaacttgctccattgtgcattggcactgtaaatagtcctggaaaacgcaacggcaatggcaatgatgttggtcatagcaataacaattggcggaaccatgagtgagctccacttgactagatacaaatctgcaaacatgtcatcctcatcttccccggccgatttggacgtcagcgtgaaagagatctcaatccctgccatcaccttgaggagtccttgcaccacagcagccaagtgagcactggttccagaaatgagccaaaactgttcgtttctccaccattgctctaactccacaccagaccacttcacctccagaatggccagcatcaccaggcatacggtgatgatgagcaagtagattaaaaaggcaatgctgagggtttcgacaatgaaggaaccagagaacaaagagagcgcggggaggaagcaatacacgacaaggaagatggaggtgaaggggtagatgccaacgttgaggtaagagagacgctggagaagctggaggcgcttgctggcgaggaatgcgttgttcttagagaagaatatttcaactgagcctgtggcccatctcagcacctggtgcaatcgatcggtgagattaattggtgccgatccacgaaatgcatctcgcttcgttatgcaatacaccgaacgccatccccggttatgcatgcggtatcctgtaaccacatcttctgtcacagacccgtaaatccatcccactctgtctccccattcagtcttgtcttcgtacctattatacatagacaataaattaagaaaaatctttaagaactcttttgagaaaataaaatgcttttgttaaagagaaaactcttgttcaagataactattctaattaatatagagaaagacgaaccaacaagaaatgacagatacggcttcggctacggtagtagcatcgagtggctcgcgaggggtcctaagaacaccgattggacgtccaaacttgatggcggggtgatctgctaaaggacgtccttggaactctgcgatgggtatgctctcagccagcatggttgaatttccaaagcgcttggggagtaagttcacgtcaaggtttggatcaaactcgctggcattcatggacggcgtttcggacccttgaatctttttaccatctttcttgtcggcgtccttgtccacgaagggagggtcgaatccgtatagagcaaatcgtcgaaacatgcatccagttcccacgtacattggaccttgaagaccatcaagggctcgcatgtttccatcaaagaacacagtgttgtggttggcataacggtctgaagggtcaatgccttcgaatctttgtgggaactggatgtagcatatgtcctcgccgcctctgtccatcatgaagcacatcccttctcgtactgccttgcagttatagacataatggtcacagtcaaggttgagaatgaatggcccgttcgacaaaactgcagatgctcgaactaatgcattcatcgcaccagctttcttgttgtgatcgtaacctggtcgtttctcccgagaaacatatacaaacattggcaaccgtgtatctacctctgtgaagtctagaatcttttcatctgcacttccaattaacggatcgggacttggtggctttagcatcacctacattcattaacgcaaaaaagttggattaaaatactattattatatatatttaagttaaattgattcttggatatgcacgtcatatctcttttattttattggttactcaaattgctagctagttgacatggttgatccaattaagtaatatattcatgtttcacaaagaacatgaatttgattttcgttactaacgtgagaaccttcatggtgtataatatattaagagtaagctgtaatactatgtgatccaactctgctaaacttttttcaaaaataaaaatagaaactgctagctaggtgccaacaaaggttggttccagttgataactaacatactcatttcgtaaaaaagacatgagttcgattttcaatgtccataaaccttgttggtaaataatatgtaaggtctactctgattctatgtgagtttctgaattcaactaagctaaactcttctcaaaattaaaaaaataaaaatttctaggtaggtgtggtacctgaagtattccagcatggtcacctttagcatgttcaccagaaggattggcccatgtaccaggccagtgagtgccatcagccatccatgtggcctttaacactttgacagactcagaagggtcagctccactctctttcatatgcttcatcatcttcatctcctctctagcattaaatgcatcagatcttctcctgatggaatctggaaggccatttatacgtaccttgaactcatcatactccctcttaactctccttctgtccttgacaaaatccgtcccgcttttgttcttggtaggatcaactttcaagctaaaatatgtgtctggattcctcggctcaatgttgtgttttcggcaaaagggaacccataaatcagcaaaacttgcagcctcggccatggcttcaaaagtcaagagagcacctccatcatcagaaacgtagcatgcaagcttttcaacagggtaatcaactgctaatatggaaagaatggtattggcagtggttagaggtggctccttctcgggatcagcagtggacacaaaaatgtccataccgggtagatcagatcgcccagtgggatttgatggggatggactatcaaatttttcatgaaggacttcaaggtcagtggaacgattcacagggcaaagcttcggaatttgatctagaatccatgagaagccaaaccatatctcacaagtaattgacataagccacaaccatactgcatctttatttggatttaccactctccagtgtaaaaaaaagcacaatactataagtcgcaccaagataagtaacctgcaaatagatacatagacatagatttggtcatgtaattattattattagacttaaatacatttttttatgcaatttagtatttttttatttttatttttttatttttttcattttagtcgtaaaataatatgtatttttcatctttaaagaaatatatagtattttaaacagtacaaaaatatttttttgaattatactataaaaaatttgtcatctaaaacattttacagataaaaaaataaaacaaacacattttaaaaaactaaaataaaaaaatacaaagataacaatgaacaaaatgttaaattagataaaggaaaaatgtatttaaaccttattattatgatcgttataattacaaactatgggcagcataaataattgatataattaattaacctgtaaggacttatgatgcctgatggaattggtattacccggctcaaaggcttccatggcttctcttgatccagcattcctgcctttagggcatcatcactatcatcaccatacatgtcatcttggggccaatatgcattaccaactccgtaggtaccttgagtctcaaacaaccacttgttatggtcaaattctccattttgatttctcttcataactgacatgttgtttgcgttacgtttggaaccatctggcgctggtaatggcaatgccccattgttagaatactgatctgtgaggtcttcctcatattccccgactttatatggctccttgcaaccgggacacataccagattctttttgtgcatctataaagcaatctctacaaatcttgtacctaaatttgaattattattatgtaacttagttagtttctcttcatttctcaacaagaaatcaaataaaaataatgtcaaaattaagaaatgatgataagacaaatgctaacaagtatccttgagacattagttaagaagttaaaaaagagaaaaattcttattcagagacagaaaattatgttttttacataatttttttacactttcatattatttttacaataattattttatctttttaattccttaaataatgtccttaggattatgaggacctaataataacacgtacctgcactcacagggagtgacatcatgtcccctctcatccctcatgaccctgccatcacaaattgaacatacagagcctttggagcctgccatttgaggatgagtgacttcagaatcaatgaccttatccattagatgcgctcgagtgacactgttgaatcccccggtaaacaaagaattagaaacatattgttcttcagctttcattgcaacagatgagtccatgggttgattgtctggggtaggaggtatatgaacagtgtagttcatgtaatcccctgataagtctgaggacgcatcaatgtcatcccttgacagactcacatatcttccacttgaagttcttctcgcaaacttaacacttggcccgctagagttttgtgacccttgagatgttgatcctccagaactacgtgcagatttcttcgaaggttgcctattaatggatgacattgtttctaattgctacaccttacacctacacctatataatttactactttttctagtaattaatcaacaaaatctacatgtatattgtattccagtgctagcctattttccattttgattgataaatagcttggtgatgattcctgaagagaaattaatggaacaagaaatgtaaatgaaattatatacaccaacattaatttaccgtggcaagatctattggatgttgaacatgttatagctacactgaaagataagaatgaaagttcaaattattcatggtaagagaacaaaagtagttagagagaagaagtttgattgacaatgagagatttgtcagagtatagaatgttgacggagaagaagaatgatttatggtgccagaccaagtctatcttacaatgctattttcagtagtctcacttccgaattcatagaagtgtgttgctctctctctttatacatgtgataaactagctatttgattttataacttttctatttatgttcaatcttcaactctttctatttttagactttatctggtttaaattttgttcacacactacttttttatttttatatgattaaactatatttcttttaatttggttaagaattttatgtattttgaagaaaaaaacttggtccattaaaggtgagatttttacgtactaataaaacatcaattgaataactaagaaaaaatatattaacaccaacaaagctaggatggtagactctcatagggttttgtgtgagacctcataacgatgcaacaccaagaagtgacacaatacagaggagcagtacagaaacagaaaacaagtttttatagcattgcaaaggaattaaaggaaatttatagagtaaaattagtaaaattaaataggaaaaacaaatctataattaatcttcacttgaatcttcagtactataaaatatattttataaaaagtaataattgaaagtactagttttataaatatgtagttaaatttaaaataatacataatattttattttaattaataactaaggatctatattaaaaaataaattattatgtatataaaaaagtatatttttaagacattggatatttgtttgtatttgaaacttattcttgaatttctattgacatgaatattggttattatttgagatattaaataacttataatgatgatcattttaaatttagcatattaattaattaaattatgttagttatttatttttatattgttttaatatatactaagtcaaattgatttgattagtgagattgattccaccaatgactcgttaataaaatgtctcacttattggatgatgggtctagttcttaaaacactgctcttaggcattgcattgtgtcttggtcctaattcgattcgaccaataattcattaatccaatgagacttcgatttccatcaataactcattaagtcattatctcaaccgattcgatgttgtatatgattcttaaaacactactccgtctactcgtaagtgttgtggtgcttgttggtcctaatttgattcgacaagtgagactctaatttgacccaagatccattaacccagtagaactccaattccacccgtgacccattaacctaataagtctagcagttcgataatcggctccccagttcttaaaacactgctcctaggtgttgcgttgcgtgtttgccctaatcgtgagagagaagaaaggaaaggggaaaaaatggtgtgcataaggaaggcgacggtgaatgacctactggcgatgcaggcgtgcaacctgttctgcctgccggagaactaccagatgaagtactacctctatcacatcctctcctggccccacctcctctacgtcgccgaagactacaacgcccgcatcgtcggctacgttctcgccaagatggaggaagagaccaccgactgccacggacacatcacctccctcgccgtcctccgcactcaccgcaagctcggcctcgccaccaagctcatgaccgccgcccagaacgccatggaacaggcatcccattatttctttccatttacaaattacaaattagtcgccgcgtccgattattttttagccctcaatttcaattttgattgatcgctgcaggtgtttggtgccgagtacgtgtccctgcacgtgcgcaagagcaaccgcgcggccttcaatttgtacacggtgaccctgggatacaagattcatgatgtggaggccaagtattatgccgacggggaggatgcttatgacatgaggaagcagctcaaggggaagcagcaccaccaccatcaccatcaccaccagcatgacggtgactgttgttccggggaggccaaggggaatcatcctgccaaagccacctgatttaatggttggtttggttgctcatgatagaaagaattgatatggcttttagtttgaaaaaatagtaagctttggttgaattctgttgtgcaaacttgttgtagatttattgagtctcgttagacatgattttttgctttgctgtcttggttaatattgacactccttgaacaataacaagattgattgttgtgtttcagtgtctttattgttttgtcgctgggaattattttaactgttgttatgatggttgattacatttcaccatgacttggtggtgtgagcacagtagttaattgtaagcactatagattagtgtgtgtgtgtgtgtgtgtgtgtgtgtggagtggcatccagcttctgctggagctccatttgtgatgcaccacagtgccagcatagctgcggctttgtgatcttttatgccaccattgtagcagcgtgtctccacttgggcgatgcatgctgctacttgtaattaattactagggatgatagtaaatgaggatgaatatttacagtaccaagttacctattaatgaactgttattgccttgctttggatgaactgaatggtaaggatgattattttcatttctgatgcaaattggataaaaggatgttgataaagaaaagatagttacttctatttcttattggtgtgtgtttgcatcctatactcattttatttttgattatcaccaacacctacaaagaatgggaatttgcttctggatcattgttttattttacgagaagtatgaatatctttttaatcactggattctgacctggatgaattgttcatccttggatgtaatgtgttttatgcgattggtgcaatattaatgatatgcacagtgcagtaaaaattgagggtgggtgtgatgtctgaacagttaaagtatttcaaagtagataagttgctgcattattttggtatagagtttgattttcctctttgatgatacactgatggccaaaagtagaactgtgtagacatccagtttcttccgaagtttttattattttcttaattttcttatgtatttcatacattttgctttaatagtaatttataatataaatattagcaggtaatcagttctgcatttgcaattttatgaaatgttctttggcctgttctatatcctatctttgaatgcacgtgttctatatcaatgggatgcttgacccaatatggatatggtgtttgctttcgctctattttgatgcggcaaactctttcttgtgattgatctgctttatttatgaagctaatttgttgaggtgaacatctcagaattattggatggtttctcactcaatgtatactcaatggatgttatataaagtgatctagctttatttgatattaggggatatcactttttttcctttggtttgtctgctgcagctagctgattttttccacttaatacaaagcactaggcctacgtggctgtatgttatccctttgctaaatagttaaattttgaacaaacctaatgatttgcctagaggatgcatgttgggttagcatggtggcccatgattaacgtgacttaaatatgcaagagtctgcagcttatataggatgttatatgtcaagagttacgctgttactaatagcttaaacttagtataatggactttcttagttatatcattggtaacaaagttagccaacatgggtttgaattccaggttcgacttgtttctgatgatcttaaggttcagggcaaaccctctccaatagagaggggaatgacgtgttcaaaaagggtcgtgaaggtacattagagtctatgggttgggttcaaactagctgctcatgtttaatagcttgcctctatgctgggcatatatgtcaagagttatatcttagttaaacaacttgatgttttggcgtagtggtgagtgtttttgggcatatcacccaattttctcctaacttaatttgtttagctaattgttatctatccaatccaccaaatctcccacataaaacccagttggaacctggttaccagtaacacgatcccacagctttataatcgttgacagtccctcaggaagtgaataatcgtttctggatgaaccaagcaaactggacacagattagagtcacacatgtgacgtttgaaacgattaacatttgttagcaacatattcctggccaccaaccatatgtgcatttgaaccctctcagggaccttcaacctccaaatagccttatacaaccattgattcatactatctccttcttgaatcagagataagtacgcattctttgtagagaaactaccttccataaaacccctctagaccaccacatcattgccaaaatcaacattaggcacacacagcacggatcttgtgaacaatatccataggtaacaaagcattcaacctgcgataatcccaagtaccatcctcaccaacatagttagccaccatcttttgatttttcgaatccgcaatactactattaatagacaaagcaatactattcatacctggaatccacagatccaaccaaaatctcaccattctgccattatttaccttccaacgaagattgttatccacttttggccaaaccgcatttattccctgccaaagatttgatccccttttccctgcatcaattaagaggaatattgaggtgacctcaattatactttgatcggacctagcgaacccaaagagagtcggtatttttaactagatgccatccatttttcagcataaaagtttgatttaccacacgcatttctcttaagcccaactcaccattgatacatggttgataaatgataaatccgaatttgattttacttttatataagttttcatgtcatattaatgcattttgatatattttatttgacaaaacttatggtttagcgtaagtttgtgaaagatagatgtttaagaattttcataaaaaatagttaaacatcatgaatttgttgaagctaatcattcatgataattttgtacgaaggcgataattaatttaaatcatacttgataatattttttaattaaaaaaagatacaaggagaccctccccacaatattataaataaagaatgaggcttcttgttttatctttatttttaagttttatttttatttttttacaaatttgagaaaatcttgagggcttttgagagctgaagagtgtgaacaacatcactaggacgaattatgattatcgtttcttcttattgatgtctatgtttactttttatataattgaacggttagttttgctctgatgatggctagttagtcctcttagtccgaaagttatgatgtaattgtccaactgtatcactttcattgtttttaatgaaattcttcatggtttatgttaattaactttctttcttttaatatttatttgggacaagtcattctaatactcaatcgattgcatagtaatgatcatcgacatgtaattggtagatttatatagaaaatgttttgtaccaaattacatgatcaaactatttggataatctttatatattagttatctttaattaatcatccttaaaattgattttatcctttgacttaagttaatagatccatgataattggtgtattgatttaaggcaaagaacatcttcttaccttgatcataaactttagttgattttagaaattgataattaactagggggtgaaatttcattatgattaggattgagaaaaaattgatactaatgagtcataatcctgattattctttttttataattcaaaatctctctttatattattttatttgttatcttataaaaagcaaagtcataaaaatattttaataatctttcctgtgagtttaataatcatttgggtttgatatttggacttttaaattcattgttactattgtgtaggtatacttttccttgcgagagcttaagatattttacgcatcattagatatccttctaagaagccatatgcactctcctactttcatcaatatcaccccacacaaactgacgacatttctgatcaactgcatctcaaatagacttaggtagccaggcagattgcatcacatacgacgaaagtgcttgaagcacagatatagttctcacttccaagcaactcaaatgttcgttgactttctttatgatgaattggtatgtctgagtggtccctctattatgaaggataggaacccctagatatttacccaagtcttcagtacgttggtaccctaataattggctaatctcctcctttgcttgccatgcaacattttttgaaaaatatactctggtcttctcattgctgaccttctgaccagagctctcacagaacaaatttagaattgtcttgatagtctccacctgctcctttgtaatcactgcaaacaataaaatatcatctgcaaaacccaaatgagacaattttcggccacctctagaaagttgaattaatgggctcccaaaattcattctccacaacaacattaacaagttgaaaaaagttgctcgatacataaaacaaatatatgagggtaaaggatcctcttgtctaatacctctttatggttgaaaatcctccaaaacctctccattccacaacaccttcatctttggggacgatatgcagtgccaaataatatccactatatttgcaggaatttggatatcttccaaggtctccttcacgaatcttcaatcaagtctattatagactttctcaagatcaatcttgatgtttacccacccaacattacccttcttgtgcctcatcgaatggagcacctcctatgccacaaaaatattatttgaggcatgtctgtttggaacaaaactactttggaatggcaaaacaagacgaaacatcaagttccgcaatctactggcaacgattttagtcacaatcttatataccacattgcataaactaatgagtctgaaatccttcatccgatgcaccatgtcaacctttggaaataaggaaatgaaagtatcatttatctccttaattctactcggttcatcaaaaatatttagcacaaaagaatttcttaccacacgtcattggctttggtacaataaagcttgaagggttttatgatatattatatttttatagcgtttatgaataggtagttagtcattaaatccaaaagatatctttgttttttttttttcgatttatctttaggttcatttatcactaacttcaattaatttgaattaaatgtgctcctgttgatgttgagtagccattatgcaattggaaatggacatatgtagttggagaaaccaagtaagcaacgattagctaaagcctaagcataagtggacatgagtatctgggaccacttgattgacccattttggagggaccataccaaagtgaaattagggaatcaatgaaataatgtcaatttgtcttttgacaacactgcaatgagaaaattgctgaaaatacaagaaaaaaggacttgatagataaagttatggacaaaggtagaaaggatatccaacacataacatgtatttcacacgatgttgtttcaatgaaaataacactattgtcatctattactacatttaataataactagagaaatattattgtactttacacggagaacaaaagaaaattgttccaattagtacataattccatttttcaatgcaaataaaagaaattatgagatggaataaagcacaaagtgttcaaatctgtccaattcctgagctaatttaatatatattgagaaatttatagaagaaatgaataaaagatatcagattcaattttgatggattatttcattaatttcttctatatttcacttaattgtgtattattaatttgttaagaaactcttcaataacaactatttcaaaatattttgtttgatgtcatgataatatatacgagtaacagataataaaagctttttccactgaaccgaagtcagttgaaataaaactcgaagatattttatagatatttgaagatttttctcaagaaaagacatctttggattttttttttcagaattggatattttctaacattgttatctttattataatatagtaacttatttttttcataattataaaataaagagaattctgaagagattaataaaaattatgaaaatagtttatcttttttataaactcttacggtggatatgatatgaacttttgcagcatgcttacaaatctactcctatataatacatttaaatgatcattatattgattttaattcataaaaacatttaattcaattttattttttataagttgattttattcaaactcacttcataataacaattgaatattatgatattctaggcatgtctttcataaattaatatcagattatatcaacctttaattgagtaaaaagtaggaacagtttaacaaggaaataaggtatgcatattaggacgtattcctaatttaaggatggtttaataaaagtcggaagttttaaaatataccactacaaaaaaaaatggaatttctgacggccaaaattcgttggtaatatcaaaattccgtcggtaatttcaaattttctgatggacaaaaatctatcagtaaaacgttcattgcaaaattaatttatggatttttttgtccatcaaaaattcctgcggatccgtctgcaaggtcagcacaaatatatccgtcgataagttatgtccgaaattaccgacagattattcatttggtaatttttcatggatatatccgttggtaattttcaacagaaaaatcagtcgtaattttttatgagtccatctgtcggaaattattaacgaaaaaatccttcagaaattctgtcgaaagttacatatcaaacaactctttcaatacaatcgatcttcattcatacatttgctaattcagctaccaataattaataaccaagaattagtagtcattcatccatcattcacacaagtgttgttattgcacatgacaaaaaattaaatcatcatatttaccaccatcttcagatgaaataattatgaacacatgtaggattcataaattactcaatgcatgtaattctaataaatcaaagattacaaaaatgccttattcctgtatacagatcagttttcttatatatttcttatgatcattaatgcataaaatgtaatccggatattcttttctcacctccattatatttatcaacgtatcagaattgtaatcagtaaaaaatgaaacgctcccctcattttttccccttcttgttgaatttttgttaatttgagacttgctagttatattatatagacagccttgttaccaagccaggtcaagtctatatcatcatgcagtgcacggcaacaatgcgggaaacaagttgctccacgcaaccaaaacaaaacaataaatatctctgcaaaaatgttttctattagtaacaaagttgtcttaatttataaacaaacaaaatcaattatacaaaatattggattgagggattttgtgtataaataaattcataaaaagtatatatatgcactatgtaggcatatataattatatattctacaaaggtgagattggctggaaagatcacaatcacattacttttggtgtttgtaagggaatattacatttcaattttctttgcatacatacgtaaataatcaatacgtaagaaaatatttaaatatgtttctgggtcttaactgggtcttaaacaattttatgtacatgtacacttttaattattttcattaactactttcattttattaaacgatgacattttttttaattatcacatcatatcacttaatagaataataataatacaatttaaaatataaaaacaataaagagaaattttgtgtatatgatttaataattgaccctaaatcttgataaatgatgagaattgtattaatccttcaacaaacataaatatcgatgaaatgaaatatcaaaaataaaataaaaatcgtaggaactaaaatcaaaatcaattttttcagcaactaaaaacatttaagaggaatattacaaacataacttaatgcgctttgatccaattcatttaccaacctttatattatatgaatttacagtactctcattaaatataagaacatctttttattataattttttagaggataaaacatgactttaattatcataatttaatatttatgtatttttaaaattctcaaactattaaccattttaaaatttatttttatattaatagtttttatcctcaaatctcgactttaattactaacgggcagtatatgtttaatttaattatcttgaaaaatgtatcagtttgtatatgaggaatctatataatttgaacctaataattgtaattgaatgctttcattattactcacaataactcatatgatatgttccctctagtaatatgtataagtttaaatactcattttttaaaaattggataaaaatcacatttctttctttctcatataacattgatttttaggagtgttcaaattcaaataaactcaaaataaaaattgaaaattgttcaaaagatcaaaaatcgaaccaaattgatttttttggatgatttttactcaaactaattggtttgtagtatttttgaaattgatacaaaatgtaacacttatactaagacttatattttacttgagtttcataatattttgttgtgttatgtatacaaaatttatacaatacatattattttatttttcatactacttttttaagatatatttagtttaaaataaataaaattttaaaaattttattataaaagattaacatattaataagtttcgtaaattattatgaacaattttttaatgtaattttatttaaaatataaaaaatatatataaatattaatgaaataatattttagtaaaaattataaaacacaaaccaaatcaaccgtcaaaatattagtttataatttgatttgaattttattttaaataaaaacagaactaaatatatttttaagtttattttaaatgatttttaaataaaaatcaaaccaatcagactaatacgccagtcattctttctcatttctggcacatgatatatggtattctatatcaaatcaaattgttacagaattagttattcaacaaaagaagacttttatatgtctcttcatctttaacaagcttttaaatctcatacgcgctctcattcccccaacaactctccaatacaaatttacgacacatcaaatgaaactttacaccagaatcaacaactccactatttttaccaatattttcattttttttttaactttaggtatctccaaacttagtaagaaacaaatccctttaagattcatttaaagggtttaaactctaaaaaaaaaaactcatttttaatgaaaagcaaataaatatctcatagaaatttcacatatctttgatataatcattttgatacctaaaaatataagaaggtaacaaattattttaataagataaaaaatttaaatttaattttcgaatgaaaaaatgtgattaatcattttaacaataaattatattttttaaaaattagtttaacattaagttataaaatttaaaaattaatttactattatattatctacacaattaatctatcacactttatacatatttaaaaaaataaatttaaattttttaccttttagatatcaatttatcattatctcacaatttttgcaattcttgtaaccattaccaaattttaaatctggttatctacgattacaatttataacggaaactaaaaatcgggaacaagattggtggaattttttaatgagtgagagcaaagtgtcggaaggagcaggaattgagaaatgtgacaaaagtagagttcataaataaagtgctagcatttgtttacggttcaacggttcaacctattcatgggccagcaaacatccttgtctttgaagcatccaaagcatgcaaccctatctcaatattctatatataaacaaacaacagctcatactctttgtccaaaattacataatagagtgtgtgtttaagtttgatggaggagaagaagaagaacaagaagagcaagctgtggttgaagaaggtgtcgtggccgtttcggtggaaacgactggatcttcaaacgaccatcatggacaccgtcgttttcaagatactctacgcggctgaggctgtagtccttgtctccaccctctgtttcttttacctttgctgtggctgccacttctgaatcatcaccaccaccaccaccctttggcttgttccgtcagaaaatatgatttagctaatttcaccacaaaaaaagattttttattttttattttcttctccaataaaatatttatagaaaaaaattgtccaaatattgttatttcattcatttttttatcattactactttgcttcaattgtatttatttgtcgagagattctaattcagttagttagttgaacgtgtgtgaattgttgtaaatttttttatattatctttgattcctgaataaaaaaattatatttatttacagttcctgttttctcgttagtaatagaataggcatagaaattaagcttgcaatgatatcttttatgctttattacattatagatttcatctttttgcttaaccagcgtcaattccttcttgacactcccatcttgctctgttttataatttgaaagcttaattttctgcaccaaattggaagatatgagatgatgaacgatcatatattatatatataatttgacatatttgcacgtttataggttggaatgaataatttgaagagcataaaagatgaattctggagaacaattttccctagcattgcaattttggctcttcctcgtactttttttttccattgtataaaagagtgcgagaaactgtttggtgaactaatatgcttgaggtgatctgtctgctttttgtttatttactgggaggagaagactggtttctattattgtaaatgcaaaaattaccattttgagtgaaattacagttatggaactaccaattttacggggggaaaatgttcgttcagttatgaatttcaaggtcatggagtcccaaatctttttcacttctttgtagaaatagtagacatcaaagagttcattagataaagtatagataatggtgtgtctacatgtcttgttggcataagttcagtcttcaatttgtttaggattggcaaaagtggaaggccgtaaaagccgatgcaatttcatgcatgtttagaatggtatagatcaatagatgcattcttgtcacttgtagaagttctcaccagtaaaaagtttgatctttgacacgttaaaaggttaggtgatcgacatatgagtaggagcaatgggttttggtacataaggttagatgtgatctttgttagccatttaatttttctctaattaaagtcatcaaattcttatatatattcttacaaaaatttgcaaactgaatttcttaatgctatgtttggtttaatgttacaaaaatatttttacaaaattcaatacaaaaatatgcattttaatgtacacaatgagaaagacatattttagtctgtctgaaagatcgttcaaatacctctaaaggtacattggagtcaaaaaaatacgaagaacatgtttgtgaacccgttatttttaggttttatgattttcgaagtgtcatttcaaaagtaacgatttattagttaaaacaaacaaaaccatgagtattactttggaggaagcatgttcatgctaaaagtaccttaaactatcctaatttcaatcagacattaaatcattttaaacttactttcacttttttttttttttataacagcaaacttaaaaaaaaacttaaaagcttgctaatcaaaatatcacactttatccgtttatccaaaaatcaaaaaattataaacattttatcttcaacacttaaaaaaaatccatgttattaaaaagtgaggatactaaattttaaaaaaaaatcattaacaaaatcaaaatcacatgaatggtaagtaaattaaaaaaaaataatgagacacaatcacacaaaacaattacagaagcaagaagttacataaaacaaaagtaatagagtaactatcctatcctagtgtctactagactaaacgaccttcgtcgctcgctcgccaaaacgaaaatcacaatggcgtcaccagcgtcggcgaggacgccggtctctaccggcgcatctccgatgcaacgcctctccaccttcaaaaacccctcctccgccgccaccgccgccaccgccgccaccccctcctcctccgccctagactctctggcctcggatcccatcttctccgccttcctctccccttccttctcctccacctccttctcctccgccgcgctctcctccggctccccggcctccaccgcggagaagctccaccacgcaatccgcctcctggagaaccagctccgctcggaagtcctctcgcggcaccacgacctcctctcgcagctctcgtccctccaccacgcggaccacgccctctccaccctcagatccgcgctctcgtcgatccagtcctccgtccgtcgcctccgctccgagctctccgaccctcaccgctccgtcgccgccaaaaccgcccagctctacaacctccaccgcaccaccgagctcctccagcactccatccgcgccctccgcctttccaagaagctccgtgacctcatggccgccgccgaccccgaaaaactcgatctcgccaaggccgcccagctccacttcgagatcctcagcctctgcgacgagtacgacctcgccggcatcgacgccgtcgacgaagagctcaattgggtcagggaaacgggagatctgcttcgcagcgaggcgatgaaggttctggaacgcggaatggaagggttgaaccaggcagaggttgggaccgggttgcaggttttctacaatcttggggaattgaagggcactgtggagcaggtggtgaataagtataagggtttgggtgctaagagtgtcactgtggcgttggacatgaagaccatttcgggtggaagtgggtacggtcctggtgggattaggggctctggaacgccccacattggaggaggggctaaagctagagaggctctctggcataggttgggaaattgcatggatcagttgcattccattgctgttgctgtgtggcatttgcagagggtgctctctaaaaaacgtgatccctttacacatgttttgttgcttgatgaggtcattcaggtgaggctcattgtttttgttttagttgtttgtttacatcagaaggaaattatgttgttgcttccttggattcatatatgctcttctgcatccatcacacgacaatagaaattattgtttgtcctttgaacgccatagtttgatatgtagatgatagatagtattgtgtaacgacaaaataggaattggtttactttaccgacataattgtgtaacgaataccctgtggcttagctttagcttattatgcaaaatggccagccaaactttggtgtttgaatattagtttggaaattgttagcacaaacaggttatttttagtttttcacacgcgattttattagtgtattgagagctattattttgtgtgtcactcttcccaaatggaagaatctgaggattatattagaagcttgaattgagtcattaattgctagtttcggtacgtgtgttttcatttggttttgaagagactgacatgacaagatctatgaatctattgcactggtttaatagatctacaaatgttagagaccacaaggcaagactgtaatatttcaattttttagtatcaatcaagtatttgctgtgcaatacaaaccatttgccagccttccaaatctttcctttttgtggtcttcttttcctctggtatgctgtaaacagatgccaaggggtgacttgtgctatgctatattacctatgcataagtgaagagggagtaaggagatcaagggtaattgcttgttgtttctcttttgtgtagaattattttaataggcttccagctttatgcaacattatactgtcaaagacctttctctcttcaaaagagtagtataggatgcagagtagagaaattgtaaaagttcatgcctgtccattctcttctgatgcattaaacaccgctagatggattttggatgcaatgagatcaatatgcaatcttttgaaaatcatctcctctgtatgtattcagagtgtaataaagtgatcaatatgttagatgtatgaagaagttgcattgatttttttagtaaggtcttttatcctagattttggaaaaaattgtgatcttaaccatgtgcaaataaacagattcaatggacttcctatttcctagggatttgggtcttcatgatctattatactttacagtattgagttcttaccaaggaacactcatcagatcatacatattctaactactgttgttcgcactttcttattttctattggatttttttatctcatttttggatgttgcctgctgcggcataggaaggtgatcctatgctaacagatcgagtgtgggaggccattacaaaggcttttgcaagccaaatgaagtctgctttcactgcatcaagttttgttaaagagatttttacaatgggatatccaaagctttactccatgatagagaatctacttgaaagaatttcacatgacacagatgtcaaaggagtgttaccagctatcaattcgtctggaaaagagaagataatttcagctgtcgaaatattccagaatgcatttttggctcattgcttgagtcgcctttcagatctagtgaattctgtatttccaatgtccagtcgtggtagtgttccctccaaggaacaaatatcaagaattatatcacgcattcaggaagagatagaaactgttcagatggatgcacgcttaactcttcttgttttgcgtgaaattggcaaggttttaattcttcttgcagaacgagctgaataccaggtaaacagaaatgacgttattgtatctaaggcattgttgcttattagatgttttaagcgctacatttattggcttagaaacgaattcaatgctatctagatcatgggttttcaggatggcaggctataaagttagctgttatataactactaatatttttggaataaagaatattttattacaaggaaagaatggattcacagaagaaggaaagttttgttgactgcacagtaaatcatggcattgttaactgcatgcataaagaatatcgtgttctttcattgaggagtttatacttcatatgtgtattgtattattggacttgcactgtatcacattgtagtgatcagcaacggtcaatcatttaacttgcttgctcattttatttttcagtgtgttgagtaattaatatttttgctagacttatataatatttttccgatgttactacctgaagtgttgtcacttgtcatggtatggtgagacataatgactggagatagataattactacctgaagtgctgttgctgtatgttttatctggaacctaaaggctttgtttccccttcttcgtgtatgagttttgcaatatatagaatcccaaagtccattttattcaagtgaagggaggatgactactatagaagcatagtttctaatcttttaattgttcaatgtcattgttatgacagatatccactggtcctgaatcacgtcaagtaaatggtcccgcaacaccagcacagctcaagaactttacattatgtcagcatctgcaagatgttcatacacagatatcatctatacttaaaggaatgcccagtattgctgcagatgtgttgtctgcttcattaggtgccatatatggtgttgcctgtgattctgtaacagctttgttccaggcaatgctggatcgtcttgagtcttgcatattacaaatacatgatcataactttggagtgctcggaatggatgctgctatggacaacaatgcatcaccttacatggaggaactccagaagtgtattcttcactttcgcagtgagtttctttctaggttgttgccttccaggaattcaacagctcctggtacagagaacatatgcaccaggcttgtccagagcatggcttcacgtgttctagtattcttcatccgacacgcatctcttgtgaggccactttcagaatcaggcaagttgaggatggctagagatatggctgaattggagctagctgtgggccaaaatttgttccctgttgagcaactgggtgcaccatatcgtgcacttagagcatttcgtccgcttattttcttggaaacgtcccagcttgcatcatcaccacttcttcaagatctgccaccaaatgtcatacttcatcatctgtatacccgtgctcctgaagaattgcagtcaccgctgcaaaggaacaaactaacaccattgcagtattcactgtggctagattctcaatgggaggatcaaatctggaagggcatcaaagcaacacttgatgattatgctgcaaatgtgaggagcagaggagataaggagtttagccctgtttatcctcttatgcttcaattgggttcttctttgattgaaaaagatcagacttcctcaaagtcatgatccagtaaataatttgtagtctagcaaattaaaccacatctgctacttctcatattgcttcttgaaagttattgaaaagagtttgcttgtggaaacatgaggaagaggcctgctacttctgctagcaagcatgaggtacaaacatttaaatgatttaatatatttttttctttttttcatttctattcatcttcttccttccttccttcctttttttttttttttttttttcctttttaaatgaaattactgttattggttaatctcgaatttcttgattatttgttgttactcctcaatgtagagaaataaagccttttgatggaatgtagaaacaagtgttgtagtatactccccatgattaatagacatgtaaacgattatttcatcatgccttacgtatgtctgccaatatcttcatgtatagtgtaaactatctttatctaattattcattaatttatttttttcacaagtttgttgcagcttcgcaatattttatgtaattatttcacgttatgacttgtaatctctcttttttgttaaaattgaagtcttttatcttttatgtaaactagaagatcctatcaaggtatgatgggtaatataactgctatgctgtcaaataatgacggcaaatgaaatggttgttaagattttttatccgtaaaattgccaataatcataaaaattcgagtacctcagtctgtggacctgagggagttcaatattcacctgtgcataataaaaagtaacggcaaaaataaacctaacacgaaataagttggagaatttaaatttataaaagaagttaaatgttaaaatgaagcttaaaataaaattaaaagaaattgcgaaggaggcccgattaacattgaagggaaatcacgttgagagcttccatccaaatccttctaggatttatttgttttccttcataattcagaatcttcaaactcattcttcattgtcattttgagtttgaaacagtcttttatttgtcactattgatttactctgttgaaaatttacaatttaaaattgtcaactgcatgaattttggaaaaaaagacataccgtaaaggttccattgccgcccattttggaatcgctaatctgccaaacttaaggtttgcaatatgatctcattaatttgtattaaattcgtttttttaagatgtattatattcatttttaatttgtctgataatggcacttttataatcattgccaatgtatagctgtcctatgatttttgaagaaataaataagatttacttattaaaaaaacaaaattttctttttttataaaaataaaggtgaattagacaaacataaagaaacagaaaactagttattatattaaaaaaattaacaaataaatttaaatttaaataaacggggatatatgactatatcatctcatacacacactaatttcgaaatacaagtaaaggcaaaaaatagatgacacagagaaacagttaaaaatgaaagtagttaaaaatagacttgacagcgtccaaaggtgtagatcaaaattgataaggagtaacttgaattagtattgaaagcttatggtaatgtgttaatttgttgtctctcaccgcaggtaaggatttgaaggcagctctctgatcatcggtggtgttttgagtgattgacagttgacacgggcctgttaaaaggacgctatctcaaaatatattaatttaatttttttttttttttgaattggttgaagttagttcgaattgaaaaataataaattcaaaattcaaattaattgatttaatttgactttgatggtgggattcatgagataaatccgatccaataaacaccccacaaaaggtgatatacaacttagagtaccactgcgctggggctgttgcagacttcagagatgtgcctttatttcatacttggtatcaatacttattaatgaataatttttatttaatttttgtttagaatctcatgaatgaattaacatacatatcaaaatatttttaatctaagttaattagagttgatgatatatgaatccaatgataaatataaaaaaattaaaaaaaaaagaaaaaagaaataggagagagatgaaaaaggaaaatgactaaaaataatttttctaaaacatagaaataataatgagtctatttttcaacaaacttataatttttttttatttcatactaaaacacaatgttcgttaatctatataacactcagttaagtctttttaactatcttttttcagataaatttcaatctacctctatctctctttatatcaagatattagtaaaaaaaatcataaaaatgtttattttatttaaatgaacacttatttttattttttttaaaaaataagttcaaaaaacttttccattaaattttataagaacgatccaataataaaaaattacatttgacttaataaaaaatgatgaatgtattaattcaaaacttaaatccatattagcaatgtttttaaaattagttattaaattggtgaatgtgttaattcaaagtttactaatgcagttatgattaaattgtacatcaattagtaataatctatatattcagaaaaaaaagtaataatctatatattttaacagtgtacaacatattaagcaataaattagtataagatagtaaaaaattataaatttacataaaatgactatgttaaatataaagtaaacataagtgactaaataataataaacccataagacaaaagactgtagtaacttgacattgtttgtgtctttatttagtgaaagaaaaatatttttgaacggtggggatttagaagaatgatttttttgtggtcctacatagaactagaatcctccacagatattatttgtggcagggaagtgccgcccttggccaagtaaaatacctacctgaaactgcaaagctgaaaccaaaatgaatggcattagcaactaactccaaaaaacctcactttatggccatcaatctcagcagcactgcttctctccactccaagccttcttttctgacccataaacacaacaacctcatcaaattctaccatccttcttcctctttactcacaacatgtgctcaaacacaagggactgacactggagttacacaggaagatgcttctgctggtaatggtatatacgctaacaattcctacccactctttattattattactattattgaatcaaatatgggcttatggggataaccatgaatttccatatttgttgattaaccatatgtgtatgttaaaataattcatttaacggaagaatttatattttattaattctgtgtgtaaattttttttggatcaatgatttagtaattacgtgtcgtgagtatgattagtctctaaatcatgtgggttgaaagatatgcatgtctccgacccaatacaaaaaatattggttgttgatttatatattaaaaaatatattctttctttgatgatcccgaccacaaatatttagaaaagtgagaaattatgttagttatattttaatatttgttgcatccacatggttacaagtggaaaaatgaatcagaacttctattaaacttgaaatatttgtaggaaagtcatgtgtttgatttcttcactgtctcaaattttcttaattttttttatcttaccagtttaaatttctaccaaatacttctaaattttacaatatgaggttctcgttcatgtctgaacttggcttctggggactttgtgttgttaggatctttatcttcttctcgtgcacagctggatcttttggaacaacttacatctacaagctcacctaatagtggtacgtaagctaacatctcctctttaaatcaatgatatgtgtaggggagacagattagttgtcttctgtttttgtaaggccattttatcactgtgagaaaccccttctctgttttgttgttaacttgttagtttaaatgaaatatgctgaagatatagacatggctggagaatgtaattgttttaatacttttaatgggaaaaaaattgaaagcaagagtagtgcctttgaaatcacaagttacaagattatatgctgctgccatatcattaaaatttcaatgatactatgaaagagcttgcctttgatgttaccttatccttcccccttatggccgcatagtataaacatttagagtagaaacaataacgttggtatcacatagtactactcagcatagaccaaattcatggtagaatttgggtgttgtaatatgatttgttcatcaaagataatgtgtttagcagtagtagctgtatgggaggtaaatagctagcatgaaagtttgaaaattgagtaaatatttgactccgctaagataagaaaaaatgtaaagtgagaaagtaaggatgtatttatccttagtttgaagtggctcaagtttacaagttatttggattcaaatcaattgtaaatgcacccttaatttctcactttagaagagtaaagtccatatttttggtatgatcatatgtctatttctccccatcttgcataacttttgaaattctcccatgccttttatctctatgttatgaatcactcctgatatggatgtttgtctcatgagttatgtgaaagaatagaaattttatagccatgtctgtttataacctcttgtatttttttatttttttttcaatattgggaaaaggattacaaagattgaacctttctggtttataggttatgaaagtgatggaagcaaacttacaatccgagagcagctcgtgcagttatttggagaaaggaatgatgatttcaccatacccctaggtaaaaacttgaagaaagtgagtgcgaagttcttcaccatctcacaaaagagaaatatcaggagacaagcttacctcaatgaagtgtctcaaaggaatgattcagttttctttggaaccataggagcatttgtgattcttccaccttttataatactaggaatagctctattaaccggctatgtacagctttttccttgaaatactatagttagcgatacttcttaagtgatatatcaatgtgatactaatagaatttcttaccttatttgttttctcctgttttagtgatagggtgtctgtcttttcccctttggttagcaaattctttttattttgaaatgcttataaacactgacaaacaatgtcctcaaacattgaaaaaaacatcatggataatatattgatctatctccatgaagtattccagcgtccacatcaaggtttgaaaaaaatatcagaattgattgttaggagaatacaacaaaaaaaatgtatcttgcgggaagacattacaaagttttcaatgactgtaccttctctgaaaaaagacacccacacaaacatattttatcttagggaaagcaattgaggtccatctgtggtcttatgtgtttcaaatacttgcatccatggcaaggcattgattcatctttcttagcaagactcagccttcatgcctgcattcttgtcatttgaactagcttttttttctaatcaagtaggaatcagtagttagttgtcccaaatcactccttggttatgtatgcagacccatttttcttgaagaaggtagaatatcacaattaaagatatctgaacggtgaaaagtatattccaagttgttatgcttttggatattttttcttggtaggcttgtaaacctataaatacattcagcacacccagtaatgacactgcagttcccactatccagtgtgcatagaacctaagacttctttttttggatcccctgcgaagaacaagaaaacagttgtaccctaatcatcatgcttcgcaaacagaaatctgtagctgttaataaagctggctctctagaaaatatgaacatagaacatgaaaaatcttaataaatttaaaagagaagaaaagtttgactgcgttgtctaagtttggtatttagcaaatgctaaatggcctaatccaatatattgcatagattttcttaataacaagcaattcattggttcacctttgtggtcgaaaaataccatttagaacttgcagccagataataccatataatgctacccctaatctttgatgattattgctgaaggagttgttgaaattttttatggatatgattgttcctgcagtggcaagaagtacggcaagcttctgttgaacagaaatacaaaacgtgcatataattaataaaaaaggcaaggatcaatgcaagaaaagaaagctttaaaataaacctagttacttttgttaatagtagaggtacattcacttctggcctttttataagttgagctaaaacttgattaatgatacagacaacagcataattgcatagttcttttcacatgctctattaaaaaatgagacaaagaaagcttggaacttccaataaccaagaagattattttttaaagattcttttttgtcttcaaaccattcattatagtcctttccaatagacaaagatgcaatacccctcacttgaccttatgtagtgactaataagctttaggacaaacaaattaactgtgaaatgggaatcttgttattcttatctccattccaccatcattagaagttaattagtgggacaactgacccttctaaactaaactgaaacgatataaataattgtacaaatatgggttgccaagtaaagggaaaagaaacaaattaaatataccaaaaaaaaattgtgagctatgatttaaatttataattataatgtaactgatcggttttaggtttagatagattttcctgcaaaactgcatgaacataaaatataataataatccttctttgattcccctctctgttggacagtctgatgactagtataccaataggcattaagaacgccattgaagcccacaagagaaacccatgtagctagtgtgatttcgaactgaagtctagaactcatcttcatgcataaaacaaccacaataaaaaggtaacttcacaaacaaaacttaatagaggattataatagcaatgtagacaaggacaagaatatacaaaattataataccaacttaattgatcaaaattcgaaagaatacaatgcaggaatgaaataccttgatgttatggtcttttttgcttgaatgtctgcctttagctttcttgtgctcttgagatgcgctaacaaggagaaacatgataaaaacaatacttaattgaaagaggaaagcactgagtttttgctgaactctcattcttcttttgttgaaaatatgatgatggccaactcaatctccactgccagtgaataagacttcaaggcagaaacactgacattcttgaatttgtatgtgtttcttctcaagctggctaaggtaactacatgactctatatgtgtatgtgtgtttgaggattcatagcactcttacctttcttctcagattgcacaactaaaaagttgagaccaaatcaggagagaatgagaccaacttgaagcaaagagagaactcatcaataagccgaaaatagatagagttttaaccttcaaaattatatatttctgtttaaagttacaataatagactaaatagcactggttgttgcatgaaaaatgatggttatgaaagtggggtgttgggatatataatgaaatgagatttcaaacttgtggttgtggggttaacttccacaagctttttgtgtttatggtggagaatgtggagtttcagaaaaaagaaaaaagtatgtcagatttcgatggagggttctaaaagacaaagtgggtcgtggtagacttcccaggtaaacactatcttctgtttcccactgctcaacacacattattataagatgcttgaacaaaacattaaatgtaagtgaataaattcaaactctaccaaaggttatttcctttcttaaattttagacatggcattcttgttcgtatcaaatcacatttctttcatgcagcttcgaggttaatattttttcatattttaaacgaccaatccatctcaaggaaattatacatcagccctttctttgtgattacgcttaacatttcacataatttaaaattttgagccaaaacttcaacgttgtccctctaattattaccagacctgcaattagaagtttttcagtattctttttcctatatttttatctcatgcttgcatctgcatgacaatggtaggtcacaaatatgattatgggatatggaaaacactgtaaataagacagtcacaactcatataacctatttgtcattgtgagttaaaattatatctgcacttgcacactgggaatagaataatgaacaagtgttaatgctgaaccgtaaaaggtgtagatgcacgtggtccctcatgttaacccttcaccgttgcttatattagtttatttttacttttttttttattactaacttagttaattacttttatagcattcttcaatttgtgttccttagtaaatgtaaattcgcttacgagcgacaggataatcctgcgcagcaagtaataacatgtttagttcaagttaccaagtgagttttttttgtcatttaataaaaatcaaaagttaataaactaataatacaaaagctttttttaattacaccagtgagcaaattgaaacgatttaattttgactaagaccatgatgtagttcgtcatcaatcaggagtatgcacaagcacaaagtatacccgtttaattgtttaaaagaagttacacactaatcataagatacagatgaagagtgcgtaaatgtacgtaaaagaatcttaaaacaaatttataatagttatccagcctacaatattgattacttttaagataacttaaatccttgccatacaacttaacaaaatagtttattaaaatccaatattaatcatatattttaattattttacttaaaatttaacattaaatttcatgttcttacttctaccttaataagctagataataaatagtaatgaagtgaggccctactgtgaagtttaaaatgaaaaccgaagcggcaatgactgaattaacacatgccttgtttatctttcttccaaagaaatcaagtttattgacaaacaaaacttaggtgcagttgctaaggtgtttcatgttttctgcagtttcacttcagtaacataaatagtctgcattaaaaatcaatgtagaaatttgagatcaaagttcaatatgattttaaaaacacaaaaaacactcaaggttgtacacttaaagctttgtcctttataagccatgcttggtctaaaatatttattaccaaaaatcagagagaacatatcaactaacaagtgataaaccaaaagtaatcgctaaattcaaaagcaacctttatcgaatacatcagaatgagtaaaatagattactctgcaaaaatataaaattaaataaaacaccatcttccaaaaacaaaatcttcagagcttgaaagaatgcaaactatgttgcaggcaacgaagtttgtcactacatggatcacctctaagctcttcctatttatacttaatgaatcaacaagcagggaaattccatgaactgaatcacataaacaggtttggcctggatgccttgtatgttgtcttcagcttcctagttggaggcctaatcttcttgaacaccaatgggaatttgattttagaattgtggaactgcttggtgctctcccttttgcacagcttagctgggatggtggcagtcttaattatctgaatgcatggatgcctcaccctatgacgagatgccatttcagtgtacatatgctcaaccgcaccattcagagtagtatcccggtattccttgtacatattgtgataaccagtgcggctctgataacgcagccaaattccataattcttaatcttggtaggattcttctcaaaaatctgcaatcagtacaaacactcaaacctccatgtccattgtccaataagacagcaatgaacctagaatacaaatatttgttcaagtatttctttcctaaaagggctttcataagatcataattcaccaaatgtccaaacttcaaaacctttcacctcatttaccatttcctgtgtgctaatgttaggttgttagtcagaaataatgcaccatatgactcgagtacactccatttatctacagtcctacacctacgccactagattgcatcataccggtggcaaaaattgacaagaaaactatttgcttccatagtcaataaaaataaaaacagaaaaagagaaataatgtgatctacccaacagatagttaagcataaatgacttcccgtagtcaaatccacacctaacagggtctctacatgtggcattatgtctaccgttcttcaaatgtctacataacttaaacaaatttaatgcacaagttaagcccagccgtataatatttatatataaaaaaaaaaaaatcctctagaattcttcaacgtagaaatctagcctcattaaaatcattttaacaagtaactagcgctcaaaagtaattcattgtagtgcaataattgatatttctgagacgaacagaaacatactagtaaaattgagaagtgcacacctcattgatggctagcacttgtccattgcttttcttaaccttcttcaattttctcaaaaaatacctgaaacaattaacattaacattgtcaataataataacaataaatcagaaatagaaaagactgcattttattattgaattagtacgaatacgaataaataacatttgaaatagagatgaacaataaacataccagaacttggatttggcacggacctcgttggtggcccagagtttcatgcggtagatcttaggatgctcatcggaatgggtaggaagagcccttcccaccacctgatactggtgaaactgcttcaaccataatcacattcacatgttaaattacaccaactcacactgcaaactaaataaaacacaaaaaccattaacattaacattaacattacccaccctcatggcaaccatctccgccgatttcgattgcttccgtcaactgttgttccactgctacgagctaatcaacaaaggatcatatatgcaaactaaaaccctaatgggccggtgccttccttagttgggcccaacagaaaccccaggctcagattgaccattttttacatttgactaacactctcaacagtaaactttttttcctttcataaagccaattcaaattattatttttctaattctccaggggcatatgtatcattttccttagaaatcaatgaaaaaaaattacaatctaaaatcaatccaatattttttacacaaggtaaatttacaaatattattgagattgactgtttaatttatgtactatgacaattagaacttagaagtcattttaagttcagcttattttaaaaataaaaccgtatcttttacaaattttctataaaggatttatagaaaaaatcatctctttaaaaacgcatccaaaccaaacatgtgcttcatcttttttttttttttttttttaatgaaatgtgcttcatgtgttattaaataagttattatggaggtcatattataccttaaaaacaaccttatcatgtagacaagtcagattcatattttatcttataaagtctaacctatttattttcacatttgtcttgtgtattgagtagtcgtgattttaatttttacagtttataatttttttaaaataaaataagcttttaaataaaataataaattgcaagttaggtttttaaaaatatcaagtctaaaaatagattacttgggcctcttttgaatttcttgggcagacctatttaagtatgacaataattcataaacatctaacatttatatgacacctcctagtgagaaaaaagagtgtatatatgatatttcttttacatgtcaaatgatataatataaaagaaaaaaatattaataaattatttgatatacaagtgttcatatataattacttatttaaaatatgcaaataacacactttaaatccgtggtccacaatacccacacgggagcatatgcaaactatacactttaaatccgtcctctatattgtggactcaccaacctccaccatccactattgttgattgagaaataatatttgtataacaactcattcaacaaatagtacaaaagaaaaagaattgtaaaatataatgaataatgtcatagagagagttgtatgagtggttgtaacttgtaagtgtatcacaattcacgtgcaactattaaaaaaaaaaaaaagtctttgaactaaaaaagtaggctctcaaggttgacttttttataaataaaaaaattaatttcatcattaagaatccagttaaaaaaaattacatgattaagaccaaagtttaaaaataaagacctacttaaaaatcccaaatagttgaagtctttaagaatcaactaagaaatttaacctaagttttaccactaacttatttttaaacttaaaacactaaaaaacaaatcaaatcattttaaatttcatttcatttcaaattaattttgtaaaattaattttatttaaaatcaacttcactaaaaaaaaataatttcgcaaatagctcactctaacatacccttaatatattcgctcatttttttttgtcaccattggtcatagacacagttatattatgaccactctctgtaagcaaatctatattaacaaggtgcataaatttattaaaattttcattgaaaattctttcacctaattgatgtcacactctaacaaaatatgctcagggtaaaacacggctctcgagttgaaaataatacccacttaattcatatcttaaccttaggtttgaatatgaccaaaaaaagaataaactaataactatagtcctgtactacttttttttttttttacaaaatagtcctgtactcctgttgcttggaatttggaggaaaataaatatatgataatagtctacgatgattattcactcaaaacttaaatataggcttcatagttcatactggttgccgatgcagaactatgaaaaagaataaaatgtaccagaacatttatggaagtaggcaaactgcaaattttacgtttaagtatacagaccaattcagcaaaggacgacagtcaaataattgtatttgtactcatcttattaaacagaagcttacacataaaacttatatttttttaatgagaaacttataaaatctacattgatggagctatttcctcttcggaaattcctataaacattaccatttactataacggcataataaggaaaaacgtctctcacaatataaaacaaaagaacaaaataaggatataaaaagactctattttaagggtaaaaaagtataactcttagcaaaagaaaaaaacaaagaaagaaatgagagagctagattgtagtaataatacacttacaataaatgcttataacacttataatttgttttttttatcacataacttgtcttatttaattctttggttacagagatacatccttgggcagaaggattgtgatccctaatacttttcccttttttccccccttttcttgtaaactgtaaaatttatcatataaaattgacgtgtaggtagtattattctttagattaatgtcaaagtacctaggccaacaatagagttgacctattctttggtccatttttcttataaagttggcagtgtatcctaacagaaaagccatggaataatacactgatgcgacatatgggaaacgaccatgtccatgtgccatttgatttatttttcatttaaaagtattttaaaagaggaaataagtataaattttaaaggatgtagtctacaagaaagtaggatagtaacaatgagcaaaccacgaactgttattgcccccttgacttggagactcaggatacagaacttcattgctaagtttctttatttcttgtgtgtgtgcatatatatatatatatatatatatatatatatatatatatatatacacacacacatatacggagcaattttcctttgagaataatgaatatacaaaacaataacatgtccagaatgatagtaagagagaacatcatatattcatatatagaaagaacaaatattaaaattaaatgagacaagctcaaaattgagcagttaaaatgtgtataaaacaaatgtttatgtttgtaatgattcagttttctgtaattacctggaacctagttctataatcaactttgaattatttatttatttttggtgtatatcactttccaatttctacctaagggaaaaccaaaaaatctaccccctgactcaccatgtttacaattatgagactatacagtatacacctttcaagtttcaaccccaaaaaatgttaaacatcagcacacttcattggtgcatagccaagtctggatttcttcatatcatatagtatgtggaaattctgctgctgatagtttccaattattgaaagggcagatcgaggattccccaaaatagccaaacaaacaacatcaggatcaatatggataaaataattctccactggaaaattccacactgctccatcagcaaacaagattccaaagtcaggtagctccatcttttcaattccagacacattgtagcatggctttagaggaggaaggccttcaacaagttcatagccgttaattttcctcacaaaagcctccttgataatctcataagcaggctcagcaaaatatgttaaagtggtgccagaatcaattatggtaccaccagcaccttctgaagacaaatgccaagtctcctcaggtatcttcagcacctcatcatcaaccataacagaatttatctggacatagtaaaatgtgtcaactgaaccatctttcccaccaccaaaagaagtgaaattcaaattggggtggctgaggagctccttgtcctcaccaaaaatcaacttgctgctaacacttgcattgctattcctatccacaagacaataggaaaaagattgaccatagagagattgcatttgagaagcaaatgacaatgatcctttccccaatcctagcaaaccagaagcaccatgaaacaggcctctattccaatgaccacatccaaacatcacattctccacatgcttcaactctgacttcccattaggagtggtgagattaacagtgaaagtctccaatgcaaaatccccagttgtattggaaccatccccataccaataaaagtagggacaactctgattctcagccttgcaaggattaggtggatccggggatgaaaccaattggcaccggggatcatgacagcttatattcctaaaagaactagaatctttggggtcataatatggcccactttgctcaaaacatgcaatgcaaggaacacattgaatccaattaaggtcactaccagtgtcaagtatcagagaaaaatgcttagggggtgtccccacaaacacatccatgaagtactcaccagagccaagactcacccctgattccaaggttgccacaagctgcccggaaactggactagtcggtgaagcaaccggagcaaccactggcttgaaggactgctttggttgctccttctgtaacctctgcagccttgaaatggtgttttggttgttcttttctatgacccttctgtgaaggttctgaattctggtgaaatctcttactgtggaatcaatcacagactttttaggctcagcacctttgctccctgatctgtgtttcaagtggagtttcaccgaattcttgtgtggttttggtgctggaaaagcctcactctcttcatcagtttcttcacctgatgtcctggtaggtacagaatgcccaagttgctcagaatatgagaagctacaatcattgtccccagaagaagagacatcattgaaacttggatgatcaggaaactttatggcagccagagaagatccatttttgttgatattgttgtgattgtgattcctagaaatggcttccacaacacaggagcatatcacaagcagaaccacaatgagagaaaccttcaaaaccatagtaacgatgatatcttctttcttggacccaatgaaaatccaagatcaagcacctaacagaatttcagggagaaaatttatttctttatggaaatttctgagcttagccaagagggtcaaagaaagaactgagttcacaagtttatctcaaaggtaatcaatcagaagcaaaatcttaaaacaagaggaaaatgaatgaagatgagggattggcaaagtaaatggaaatgaagaaaaaaaaatgtgaacttatgagttttgaggccaaaacattggttttggcagatgggaattgtttttgacggagagaaggaagaaagaaggattgaaaagcaaggtggtgtgactttattagtaacaacgaatgagaaagacttggaagcctaatgtcaaaggttgatcccaacaacgcggttttattcacaataaagccttagtattttatgggttttggtgatcagcattctgagtttctctcgttgattaagaaattaaaattaaaaatatttattatataaatcataaaaaattataagaaaatttatggatgatataattttttgtctatccattttttttccaaattggaatattttaaagagatatatgaaattatattggtatttgcccctattttgattttaaattctttaaccaatgttattaaagcactaattattatttatcatattttatcagcccttaaaatgaattataaagtttctaataaaagagattgtgtagaattttcattttggaaaaccatttttaaaaataaagaaaacatatagtacttatttgaagtgaatttctcatcacggatagcattatttcaaactatttacacctccgagttaggattacatacagtacttcaaaagaagagacttaggattacattccgagttttttagtgtgtttttatttaagttgaaaatatgatgtgtgcactctatgtaaatttaatggataaaagtaagttaaaagtaaaaataagagtgatgatacttctacaaatctaggtttgcaatcttctattcaaagacacacttattttacctaagatgtatatggtgtgcatcaatcttaacacctaaaattgttgctttgcgtctttttatactaattttagaaacaatttttaaaattcaatatatatgagacattacattttgtatgacaaatctttttgatatattatctgttgagattgtgtcacgcagtgatttaaaataaaaaatttgatatataattactatcttaaatttaatacaaaaaattatcagaaattcaaaataattatcttagagataaatcatatttaagtctaaataataaatgatgtttggtctggtattgttatcacaggattttcctctctggttcctgcttccttggcttgtgattgtgtcacagatattacttttgcctcgcaaggctgcaactagcaaaagtcaaagacatggtgtttgataaatcatgatccaaaaaaacaaaattggagctgtcagagttttgaaccagtcgtcatgtattgaacggaacatggagaaagacaaatccacctttgtgacttaaataatgaaaactaatgctaaagaatttgttgacaaagtaaataatagtgattcaggagaatgagatcattatcgacccctttttatcgggtttgaatttgtattttaaaaagtgtagctaataatgtgccaagtagaggccaaagggagggccccaaagatgtgtaattttcttgcttagttcctcatggtaattttttaaaactatttcttaataaaaacgtatttttagtaaacgattcctttattattattttttgttggtttttttctattaggtatatagttttttgtttttgtttttgtttgattcttttaaatattacaagtatatcatttattgctttttaaatatcattattttatttaattatttcaaataataaaatttaaaaaatcttgatatttaaaaggttcaagagaaaacaataaatggaaaatttattgtatacaaaaaatatattttatacaggtatatgtaggaaaaaatttaaataaaacattttctagtaacagtaagtttctcttaaaaagatcatttgaaagataggtaaaaaaaattatttaatttcaacatactattaatttttatatcgttatcaaatcgtgtaacattaaattattaaaatctttattatcacaaacttgaaaaatatattcttcaaaattttattttatacaagttgtatctactaacatatcattatcttagtgaaatgatctgaaaagagaaaattaaggatgcaataattaatgtgatgtaaaagaaaagagagtaaatggaatatattgctatgggtgtggctgcacacctaggcagttttctggttggagcatgtgaatacgtgattatggtgtcgtaacgtgcaaaatgggttcctggaactgattgtgaataccccagaaatctcaatcactaggcaaataagtgtgaaggaacattgagatcatagaaaaattagcatagttgttgaaattcgatgcaaacatacgtgccaagaatcaacaacaaattagtgtcttttttccttatccgggccggggtaggaagaggttactagtactttgaaaagtgatagactcttccatttattaattcttggattttactgtaccatgttgtaatctttcttccacgtgatacttcctcactccgaatacagaaaaaaaaaatgtttatgctgtataacttccaagttttttcatatatcgatcagatagatgtgcactataacatgactcgtgtgggtttgagtgtcacaaagcttaaaatgaaagaaaaatatacacgaaatcatttcgctagtgggtagtgacactttccgtgaagaattaaataaaagaaatctaactgtacgattattgtcttctctagtttttcacttgtgacttgcactgacaatagtggtttgtggaacctttagccaaaaccacgtcttattcgacgtccacacccaacccaattactttctactttatgttgatttattattgttgtagatttcttgtactaattgtagtgttgtattaatggtacaggctatactatatattattttcttaataaaatcttttctataaaaaaatactaccatcatacctagacattaatctaattggtgactattattatagatatgtttggataagtttatttagaaacatttataaagaaaatgagatgaactttttcataaataaaaataaatttttcattagctaatttttaaaaatacatcaatataacttctctaaaagatgagatgacatctacaaataagctaatgaaaaactcattttaattcataaaaaaattcatttcatttttttctttttattttcttttaaaaatattctaagaaaacttaacagttaaaatgtagactttacgccgaaacctattcacccatttcattttttgtttatgccgaatcctattcacccatttcattttttgtgcattaagaagtctaatagtagaatcaaacacccacaacatgaataatgaatatcacctgatctcatttgtcaaagcatattgtatttgcttggactatgaaaattgccattctatctatctatgtgtagacaacacgagcaatgtctgtctttcttctactctatcttattcttatcacgtatttgaatgagtccgctattaaccgttgttttgaagtcgttttctagttttattcataaatggaaaatttatcaaaatattacatcagcttatctggaacagaagaacacatgataacgcaattaatatttatcacccttctgaactagttcgaagatttttttttttattgtataaaaaattgtaatttatcacaacttaaatttacctctatctattcaatcaactctttatgtcctaaagttacggcagttaaaattagtcaacaaactaaatttatttcatttttatcctataaatacgatcaatacttgtttaatttccatttctttccatcattaaattgaattgcccaactagagactatagtttcagttaactctatcgttctcgtatacagcacatgacccagagaattgacatcttgaacatcaacttcagttattagaatgtaagtggcactcaaagctgcagcagtcactactatttcaagaaaaaaaaaatccaaatatggcaaggttaagaactcgtccctgtacatagtttggtcagcacaatcagcggagaataaggtggaaattttgcaagattatagccaattttttaaaaagcatgtcaattctaccatggaaatgattagattagatataagtgattaatatacctaaattaagattgaatcatttggatattattcggatttagttttgacaaaaataattattaaccaaattttatttatcttttggttaaattttgaattagtcaaaatctttctcttcatgaacaggataattatcaaaaaaaaattggaagcattgagttggaggtataatatgttagattgatattttattcatattgtaaacttaatatttttatgctttattttttgtcactatttaattagtatgatatatttattaactttaaaaataactaatctttattaagaatttaattgaccacctatacatggatcttttttatcaactatatttttttaattcacaaaacttagacttgaaatctgattaaaatataagcctagttccattaatatattggtatcagtatgttttcttgaacgaaatctatttctccagcttaaataatcttttagtcccgtcaaaacatgatatttttttaatcatttaaatattttttgtttgattttagttcttgtattttttttgttttaatttttgttatcaagtgataacatgacaacttattaaattatcacgtcatcaaataaggaatttgataaaataattaatgtactttttttcttgaatgactgtcaacgtcagatcaattaatgttaattcacaacaaaatttaaaaaatgactaaaatcgaaacaaaagtatttaaagaactaaacaaaataacattgatagtatttatattttaaattaggtaaatagttatttttgtccataaatgtgtaaagtgctaagaaattcgtcctgaaagatgaaaatttaaattttagtcaccgaaactaaaaaaagtgtaataaatccatccatatattaattttcgtccgttacagttaatgaaagaatctacttaacacatttaaaggtgaatttatcaacgctttacatattgagagacgaaaatgactatttatccaaaatataatttaatttttatcttttttttaattgttccaagcataacattataataagcacttaaaaaatagaaaagcaatcataagttagaataaacataataatattaattaataagcataatatatctgttgctctgaaatctcaataccttacccaaaaatgagattcaaacaaaaatgcttgtttaatctaagcatttttgtttgagtctcattttttgataagatactgtcacaatagaaatttcagaacaatatacagattatgtttattctaacttatttttgtttttttaagtgtttattgtactattagacttgcaacgattaaaaaaggaggggagatgaagattaaattatattttagataaataactatttttgtttctaaatatataaagtattgacaaatttgtctctaatgtgccatgctctttcattagccatatttttatcttttgagacgaatttataattcctctatagacatgaaaataactatttatccatgaagaaagaccttgaagccctggccatcgcacctattcgtggcggtacttgggtgcttgatgtccacccccatttgaatgaagaaagggagggaattattggttagtagttacagaacccttcaccaaacacagattgcccccactcagttccagcaaacgatgtcgcattccgatccttcaaacagatactcctacacccccactctaaactggaacactcaagttcaccagtatttcctcaaagcctacggcgccgaccacttctctcgcatctccaccgcgctaacgtacgcactacgcaccctcttcccatttccctcaaagcctattattttggttgcaacttttaattttgattgagctttcgaattcgcaggcgcccttctcgctactcctgcatccgagtcaacacgctcaggtccaccggcgacgccgtcatcgacaagttacggtcgctcgtgccgaatgctgacgtggcatcggcgcaatccgattccggagatgacgtggcgaatccgttgaaggagtgttcggctgctgctgctgctgatccaatttccaagtgtcagattcctggacttgattatgtggtgtttgtttggggttcgggaccgcaccccatcgtgtaccgcgatgagcctccgaaggaagtcattgttagtaggaagtgtgctgaggcagttcttcgaggtgctcaggttagtgaatagtaatatctttgccaattgccaaattctatgttgtgtttgggagattacagattatggtgaagaatttgattggctcctaatgttagttttgcttttaggtgtatgttcctggtgtgatggcttgcagtgctcatgttgagaaaggagatacagttgcggtttcggttgctgtggagaagcagggtgctgatggaggatgggggattgctatgacgcgtggcactgttctccaaggatctgagacaggtaacaattgtgtgtttgtgtctgaatgctgtagatgtttaggtagactttaattttaaacttgccaatcagatacgtaattgcttaacctgaaaaaccatcagtggataattggatagccatccgggagatgaaattgtattttcaaagagacatggtaacattttctaataatagagtttgaaatagtaagacatgagtggattcttctttgtagaaaacaagcaaaggatgttttgtttgtaatcaaaatggtttgtttaggaggaggataaatgtttctgttgaagtaaagttttggaatatggttgataggattttgtatttttcttgttttacagatccttattattttgaacgaaatgggatttatattgggcaaggaacagcaatgttgtcaagggctgggatgttccgagtttctgaaggagttggtgtggatatgaaggatagagtatatgaactgcactatgtttactttgctctgttggtttttcccttttcattgctgttttactattgttcttattttaagaaggattgaggattccttatcctctcatctctttgtaattttttttccctttatatagattctttttttatactcagatccacaaaagggtgagcggatactagatatgtgtgctgcacctggagggaaaacaactgcaattgcaatacttatgaaggacgaaggagagatcattgcaacagatagatctcataataaggtgaatattctgaactctagtgcattggaattatacattgaatcacactaatcgaatcgcttttattgtctaacattctgttttatgttgaaagtagtgtttgctaaatgcaaagatcgaagaaacttattcttatattttcaagatgaaagagaaaaacatcagctgaaaagaaagaactgtgaatcattgtttgtctctgttgcatgagcctcatcatcatagtatcatttagtgttaaaaaatggtctggaaagtgaataatgatgtcaaatattatgcttgattagatttattgaatttctgttggctcatttcttctgtgctatggtttgtcactttcctgttttatattttgttatatacacaataagcatttctgtatcaacattttacaaatgcatttttaaataatttttaaaggtaaaggcaaaaaaacacatggaggagcttatgttagaaaagctgacatccggaagaacatgcgaagagcacaaaatggacctggaagaaatcagtgtgtgggtggtagggttgatcgttcaaaaggtttttctcctgacagttttgacagagttcttcttgatgctccctgttctgcccttggtttaaggcctcgattgtttgctggagaggtagaagtggatctgtgtattgaaatttatcctgcatttacttgaatttacacacacatgcttagaccaatctagatttattggtgcaaatatagataggatacggggactactggcttatcttaaaatgaaattgtgttctcatttttcttttcttgatttataccaccattagtttttactactaaatcctgcacaaataagtgtatatcttaacctttgcctgaaacacaggaatgtgtagaagcaatggttatttcaatgtgattggggaaaaaaattattctatggtaagttcacccttttttgcccagaaagtgtaatttgtgaaattgtcagcatgaattatatattggtcaatgtgatgcatagtcatcatctctgggtggttaagttagtttttattgttcatttttatataaaaaaatttaacccacaaaaaagttgcttaaaaaaaaaaaaagaggaataaccatgcaatgccatttgtttttggcaggaaacaattcaatctttaagaaatcatgcaaaatatcagagaaggatgtttgaccaggctgttcaattagttcgacctggaggagtaattgtctattccacgtaagtatgcatttttgttgatcacatttttctgtgcatgctcacaagttttctattacaacatgtgatcatgtttctttcctttcactttctctcataccaaacaaccaaaaaaataatctcactttccattctttttcttcccttcgcctttctttcctttcactttcttacctaaactaaacatgacattagtaattttgaaatgtatttgtaatggtctgaaatatattttatttagtgtctaagttgcttcttcggaatctgcttccagccaaacagcttaatacaagaaagatttaagagattttttgttttcaattatcaagaagtttgttttgtacctaagctgcctcaaaccattatgttatctttggatgggcacttctgaagttttattttaccccgttttatttgagacgtttctttaacactgatttgttgatggctattgtcttataacagttgtacgattaatcctggtgagaatgaagcattagttcgatatgctttggataaatacaaatatctgtcattggcaccacaggtttgatgctaattctttgcagtccgaatttcctatttttattcttttgaattgattaggcttcaatatttctcgggctgaattactatcttgattatatatgtaattaattgaaggatgatccctcttacaatttataaataagatgggtaagtggtgactacaaacaaattttgatgtttagtttttctgtaatgaattattagttcacttggttgagttattcggatttactatttgattacccaagaattggaggaccgggtctagttggtagctgtgaatttcctgatggatatatagagtaagcccttcatccatttgtccatgattgtgcatttttatctctcccttacatagatgatcttgtatacacactcatctgtgatgctgtttattattgtttgtggacataccttttatttctttttatccaaaataataaataaaaaaattcagtgccaatttttggtttcacaccatgatatctatgcagggagtggttacgaccaggggaggaagaccttgttcagaggtttgatccatcatctccccttgatacaattggattttttattgccaaatttctcgcggggtctaaagatacctgacaactattcatgaggtgttggcgtggatatatgtttacttcataattgccactgaaggaagccatcaattttttttttatgattggcctctggaaacagtctgagagcttcacatatgtccatttggaaaatgaattaagaaaatttcaacaatcaagatggacggcgaataagttgacaactattcatgatgttatgtactgtagctcccattttgcatctgtgcatgtacccatgtattgtaaacttattgagttaatttgtttaaatttatttgttaaaaatacttatttttaataaaataagtagttttttttgtttttttcgtatgtttatttaaatcttttctgtttaaaaaaaatattttttttttgtttattttgaaaagaaaatcttatatgcttattgaataacttttttttaaagtaattattttaaaaatatttattttaagtttaaactattgtaactcatttgaaactcattgagcgtaactttacgtgtgtaatagataactaatgtgattagatggaacactcgagtcatacataattaagatacagagcgtacatatatatttcggcaattcccaagccttattactgtttttcaatgttagatataatatttctttgtgcttcaaactttttaaatatgggaaaagtgcctaagtaattatcaacttgtcaatattttttatgttcatcaaatacgttgttaataacttcttcacatttatcgtgagtctaacaacttctctgataactcacctcaatccttcccaaataatgtcaaccaaacgctactacaaaaatttaaagggtaaggataataagatttaaaaattcaaaaccattaaaaaaaatcacaaaataggcatttatgcaaccttacaatgatgtaattgagtaatcaattcagaggtttaatccattcagagatttaatccaattgattgactatgcatgagtttgttctaaacttcctgatactagaggttgactcatccctttgaaccactgaataatcctgattcatatagttatcacattatcaattctacatagccaaataggtcctaatatgtagatattgtcctgaatgaggcatcaaagcaaggtccctctattttactattactttgtaagcattcatcttatttctcaactatcatgcagaatatagaatgaaagagatggaaaaaataaggaaagcataaatggataattaattaacgtagacatgctgcaagtaatttggaaatcgactctttaaactaattattataactctttttctttcacttatgtcttaatagaatttgacccaaacagcatttacacatgtagttctgctaacttggtcttcaatttacgaattactaaccagattctttcacacatgagctattttagccccttttcccctcttctcttctagagctagctaaaggtaaactttaatatgcacctaaatatcataatcttcccacagaaaaccataacttgcctcattagagacaagcccatcacaaatttgagagtaacattcttcattagcataaccaaaatccaccatcccaacaatgtcatctgaaaaccaattcattctcacatcattcagtggattagttggctccatcatattgagccactcaaagtcatggcacccatacttctccaaacagttctgctgctgctgctgctgctgctgcttctgttcttgctccctatctatcatgtcaggatgagcattgttttcttctacggattctactatgcattctactttaccatgatccttattatcatccttgccctcttgatcttcttctagcaattctcttaggatggccgcatcaatttcaaagacctccaaatctatctcttctaagttcatatcattgttgtcatataaggccataatatatatatatatatatatatatatatatatatatatatatggaagagtggggaatgaagcagaggaaaatgaggcaattaactggtttacaaaatgagaaggttattatcttacatattttgaaaggatgtatatatgttacacatatatatacacacccaacaatgataagcaggcggtaaaagtggccatgacatgaaaattacatttacctaatattgcggaatcaaatgctgatgcaaattgaaaaggggactgaacataccaattaagatgagaaggttctaaatgtgtagatgtacttatctactagaatacggcattaatcagtcacaggaagtgacaagaggcaggtatgaaaggtttcgtggttcacgattttcattgccatggatggagaaggcaaaaccaaagcaaaggatatgcctctaataaataatatttggccaacaatatctaaatgtaggtacatatttagagagtgtgtggttgtcgtctagctaattgctatgccatggtgggagtttgattgccacatttactagaatatcatgttacgtgtatttctttggcatcttagtttggtgcaacgtatgctattagatatgattgtcattttccagtaatatatcccacctcgtgacttgtttggtttcctttatctcctttctgctcttctacgggtcttcggtttaggagaaatgcttccataaataaaaaccagacacatatatagtaaagaacatttacatgatgtataaagttgtattgcatttacgcctattctaatataaacaattctgctttaaaaattaaaaaaccatgaataactatagataactttatcgtgaatgtatttctttttccaatttagtgacgatctcactgtgtcattcacaataattttttaaagggatttgtaacatattccaagtgaaatttggggttaattaaccccatatacaagatgttttatgtaattaaaaaaaggatttctttaactgaccccaaatgaaaatggggttaagcaactccgtctttgatgagcaatagaaattacacaattatcttaagttttcaattttatcattaatgttataactatcatatttaatgtattacattaattttatttatgtgtaagattaaaaatttataattattaattaaaattatattaaaatacataaatatatgtaaacaagttataaaatattgaaattttaataattatttttaattaattataaaaatctatattttttattcactttagataactaattttcatttattttaactttaaaaaagtaatctacatttttaaaattgattgaaatatataaaaaaaactttaggtaatctcattttgcatatagataaagttaagttttatatatttcaataaattaaattttttttctttctaaaattaaaatatatgaaaactatttacctaaagtttttttatgataactatttacctaaagtgaataaagaacatagttttctttataaataattaaaatactaattattaagattttaatattttataattttattacatatattcatgtattttattataattttaattatttcttttaattaataattataaagttttaattttatgcataagaaaaatatacatgatatgaaagagaattaaagataatgcattaaatctgatagtcataacactaatgatagacaaaatctttaaatacttacagtttgaagtacatttttaaattaaattctcacattatctaattataaaaaataaagaaaatcagtttgaaccctttttcaaatgccttttttatttttttatcttaaaatatttttaaaattaacatattaatactcacatataatatttatatatggattgttattatttaactttttaatacatatttttcttgtaatggaaactaattttcttaaataataaaatagaacagaacaattataaactaattataactccttaaacaactaaaaaataattcaaactcaattaattaaaagcagaaaacaaatagaaaagtaaagatacactggcataaagttatattagttaatcataattcaaactcaattaattaaaagcaagaaaacaaatagaaaagtaaagatatacaggcataaagttatattagttaatctctactactgattcagttcttggtaaactaccaagttctattaacttttcacaagttacaagtattcggtctcttacaaattaaactctatcccaagtttgatcaacacccaatattctttgttttattaagttattgttggctgtaaacaaatcagaaaaaatttatgatcgaagattgttcgaagactaaaatagaatcgtcttatagacgcataaataaaaacaacacttagtctttttctctcatgatattcaaggtgttttgagagtttttttttttttaatcttacaatataatataaagagagtcttgttgaaggagaaaagaataaaaaaatttgtgtgagatcaattgcttcagtcttcaaaccttcttgtttatataggccctatctttctttaagtatctgttgtctcataacggagaaatcttcatttgatcttcgtttaataaaagaggatggttaggtgaatttaatgcaaatccttttcttacatataaatctttgtttaaggtttgtgtgtacgagaaattgcaagtaggtactgttataattttacctttatatttatttataactaattaaataattaagactcttgatttatttttaatacataaacgcagcaattatagaataatcttaaataaaatagaacaattataaaaatatgtaaataataaatttaatgttaaaatctgttttatcaagtttgttcattttcatggaaaccaattttattaaataataagatattattttaattatgtaaaaatatatattattttcattatgttcaataataataaaaacaggatttttatttatgtaattaataagggtcgaattttggtttggataattattcgcaaaaaaatggtatcatacctaacttatcccatccctaaacaaattaacacctatcataaaatgtaaatataaaatttcgtatttcttatattttataattaatatttaaataatatacttttaaattttttaaaattcagttaaatattatacttttaattaatattttattagttaattttaatattaaataagatttttatttactgatttgttaaaaattatacattaaaactaaaaaacattgttctagccacaaattacttccaaatctagggtttcaggggcatattacatatatattagagtatatatagatgtgtgtgtctgggatgatcggtcacacacacatgtagctatatcaatatgcacgtacggttgcgtaatattttatactcatttcacttagttttttttctctttcttgcaagagtataaacttaatagaaatgttgataaagtccacacagaaggcgtagttttgttttaacaaatatctatgagtgttataaatctcttttgatcattgtgcttttcttttttcctttattaaatcaattgatataaaagatcccatatggataggacaaccagtacggttgagcatcaaattgataaactgatcagtatggccttctttcgatctggagcagaaacaacagtgatattgggaatatttatatcacaatgaaagtggaaatgccaagttttataagaaaaagtataattaataaaaatcctacctggtttagtagtttgagccgtgcaaactacttcctaatcaacaaaatcatgcatgccgtcaaagttggatattattgctctcggtgtttttttttttttgaagagagaataggaatatattattataaatcagaggataaaagctgtacgtacataagataaaactaaaaggtccaattgttttgggacctcatctacccaaaatgtatctcccaattgaaagccaatttggctaattcatgtgccactttattccccttctttttgtaaaaactaaggcactattactttcttcttcttttttatatcaaggcactattactaagatacttgcaatctgcaacaattcctgcaaaataacttttgttatttaatttgtatttggactattcctgctattcacaagctgaaagcaatcagactcaaaaatcacattggtgatcaaataaaattctgcagcaagcttcggttcaaaaaccatgtcaagtttcctcgtgagcatgttgaaggttctaacatatcttctttttttttacaatgatcgtactgatgtttaaatctatgacctcagacatattatttcaaaggtccaagccctccaccactaagccgacgacctagtgattctaggctctaacatatcaaaaaccaaggccctcaatcttcttctgtttggtcagttttcctccctaacttaatcaatggacttttcttccttctgtgtcaccttctctcggtgattaatgtgctgctcaaaatttttaatagccatgccacattaaaaaggaatatatatgacatatctatattaaataattaaaatgccctaagttatagataacgaatttgaatcaaatattggtcagtgaattttatttcggatatgttaactgatcagatgtttcctttttttattctaaatgaatatctaattaagatttagaaccaaatcctctattgtggattctacaagtgagttttgatattgactttttgaagacaaatgaatacacgcgatgtctagaaataactaatgagaatcctaattttaattaattgaaactttgaaacaaaaatgtatatatatatatatatatatatatatatatatatatatgacgggttaatttggtgcaagccattcataatgtatcatcatattggtcggattatttggctatattaagtactctgttaatatctgtactaattaggtattaatacatttttttattttaacaagcatattatcgtaattcctttactaatattaattgtttcaatatatttcatattaattatattaatatgacacaggtatggtgagggtggtagcaacaaaaaggccataatgaaaataataacaataataatgatagtagtaaaaacaaccacaatgagaataaccaaaacaagtgcataactatggaggtggtgtgaataataaagatgataatgataatgaaaatgaagacaatagtaataatactggtgccaatgagtgcgatgatttggtggtaataataaaaaaatgtaataataataacgatgatgccgacaacattgacaactatgagggaggagataagaaataaaaaaatataattattaaatgagaagtaaaataagtatttttttatcttttaagtatttatacttgaaacaaaacattgtcatgatttatcaacaaaatatgatagttttgtcctagtcatttttacttgattgtattatctcattatctatttttaaaatgaaacaagaaacttttatatttatattatccaataccatacgttttaataaatcaaataaatttatgcatagaaatttaccaaccatacccttactattttttttttaaaaaatgaaaacattaacaagttataattatgatcaccttaaaatacacccaatatgaactttgctagagtactccaacaaaacaaatgggtttatgtcaacaaatccttgaaatgcacctatttcatgtgagaaggaacactttagcaaattacaacttaaatacacctaagatatatataagttgttaatgtgctgtttctaaaacacatgcaattggatgtacgtttgaatctcattaaatgtcttatatttattaacatatattaattactgtaataaaataatatgtagattcattgtatttattaaatgcaacaataaatgtataaaaaaccgttcactttttatttaacaatactttttaatatgtatagattgacaaatactaatgttaaccaattatcttaattagtatattagttaaaaaatttaaagtgaaaatatttttattgagagatgaaaaattgtgttgttcatgatcatttttgctcccttttataatttttacactaaatattttttattttattttcttaaccaataccccaaggacaatggttaacaagacttatataaattatgagaaaattcatacatttaataaatatatattgtattttttaaatctaataaatattttgtattgaataaagttaaatttaattaattatctatcatatttaatatatatatatatattaattacttgttagaaccctttcattaaaagaaaataaaagacacaaatgaagaatatctcttttaaaattacctacattaacttaatccctcctcatattataacattaaatactttattactagttctcaaatatagtttacctatatataaatatatctagaaaaattggtagataagtttttacattatcaattaattaaaaaacatattgtatcccttgaaataaacataatcttttctaacattattatgattcgagtagaattagatttggaccctttgagtaaaatcttatgtttaagtctttgagtggaaaaaaaatataattaggagaaaaaaattcattaaaaatagtcagatttctaagtagatgttattagcaagaaaaaataatttggagaaaatgaagagggggggggggggggggggagttgtgtttagttttccactataaagaaagaaagaaaaagaagaaaaagttgaatgcacagcgagcaagtaataaaattgattatttattttctattaacatgtttgagaatgggtcctaattaagagaaaatgaaaaacaagacatcatggatgtaatttgctagatacaattcttggaagccttgtgaagaatggctttgaagttgtgaagatcatatatgattctgaggagtccttgctggtatcccaactcatctgcagactgatcaagcaactcaacaatggttggatgctgaatcgctttgatggatacccaaatcttctccacgttgtgtccccctttgcccactagcactggaacataccctttgcgaccttcttccatttcgatcgatcttccctgcaattgctttctcttacagaagactatgtattaatatatatagggctcttcactggttggatgagattaattaacctaaataagtccttgcggcatgcaattggcatttaattccttaccatttaatatatctgccaagtagcatgcttgagtcacgctatttaattttcatcaagtacatatacagaaagtacagagtgacgaaagattattattattattattattattattattattattattattattattattattgatgttgttgacggttgaatttttatttatcatatcataactatgaagtatcaactgactttgttaataatcattttttatcatgaaatctaactaaatatttttagtgattttttttttttgttctttagtccacagtgctttaatataaaatatttgcttaaagaattagagtgtaattttattttaatcatgttgataatgtattgagtttgttaatgcaaggaatgaatttattaaggtttaaaaatttattcttatgcatatgaattttggtgtgtaatatttacaagttaattatatttttttaaagtattcttaaatattatttatgttcagataagtaataacatctttttttttatgttcctataataagatatggaaaatttatatcataagagtatatgtacagaaaagttttatttttattttcaaatctaattatactttatatatatatttctattattatattttattttcattattttgaatttaaacattttaaaaaatattaaaatttaatcaaacatacttttgaatttagtcaaaaaaaaattgttatagtatttctgaaaacatcatcccttataatacaatattaatatagcttgaaacatgcatacaccagcttggactttaaatcaaacaaggttaggtttgttttgtaatctatcaattattttaataatgaagtcatacttctatgatcaaaacataagggtatttcatggtccttgtcacaatcactaagatattgacagatatatactcgatctctcaaattgatttgccatgccaataaactaatttatatatcaacttccgaaccacatatggggtagcaagcatgcctacgcgcagaaaagtaacctccttatgcttccttttcggtcttttatttgatttgggcggggctaattaattattaattatttaagaagattttttttttttaaaatcaagaaagaaattacttctactgtaaaatggaaaaattgtgtattattattattactaatattattgaattaattcaaagcaacccttgaattttagcatttatgcttaattaattgtttttacacatgaaagagttattctccaactatgctaaaggtgtacaagagttaagatatatactaacaaagctttcaaaaaggaagtgaccacgccttgcagttgcaggagtaagtctacgctcaaactatgaaaataataataataataaaataacaaaagacggaaaatcgggtgacctgattctcttaaggagaccacaaattctatatagcaaaaactcgattttcatccattgtcatgcccgaattcaatagtgctttgtaaacaatccagataaataaaaaaaactgagttctacgtagtcttttaatactatattaggaaaatttctccctagataaaacgagtaaaccaagatcggtcatgggcaaattcaataacatctaagggaaggatcaaatgccagcaaatttttacacatatacttttatattaataagttacaaaattatatattctgaaactaaataaaatttacctatatagttgaaaagcaactgcaaagtgttacggttatgatctaataaaggttagaatgatttttttcttaattaggccatgaatgtggctatataaaacatttaaaaataagaagaaagccaagaaaacatctatacaactataaaggataaggcataagactgagggaggtgaagagctatgctagggttcctgctaagagttctaaggaagaagaggaagactcttttaactatagtaccaaaaaggttaagactaaggaaggttcgattacgatagatgaggttattactgagggcatctacaaagacaatatgtagaaagataaggttccaaagtcctatttggataccttgttagaggctgaaaaagagattgtggcaaacttccagagctttgtagatgatatggaacgtaacactcatagggtagatgttacaaggtaattaggagtatgacaataataatgatgctacaaagctataactatgtccaataataattcctatctcgaaggaagaatttgaataatgtgtgaccgccggaagaactctcatattgttgatgccttgggaagaaagatagttttaattatgattgaacacaagctacccaaagaatgggctaaaatgggaactatacgcattatcaatatgtcgcaagactactactaactagtttaattagttctcggtaaagaaggattaatggcatgtcctatttgaaggaccatggatttttttttttttttgtcagcaaaattactattatataaccaaaaagggtataagagatgcccatttatatattacatgacatatatttccttaaaacaagtgacccctctaatggttatatcatatttagcagactttgatgtttatatctacattctaggtctttccattgaattatatgaggataagttcttatgtggtaagcaggtccaaagctgggaaccattttaaaaatcgatatgctaactttatacactccagagggagattttgcagaatctatgttgaaattgacctaggaagaaagctagaatatatcgtgaatcaatgtcttgggttagattctaaaattgaaatacgaagggcttcactcaatatattttaattatggcaagtacgatcataaagaacccggccaatccatttttagaaaatatattatactaccttcattgaaagtaattaaaaatactacttaaatactattttttttttcaattttccaaatggtcaagaagattataggaattggaagagagaaatatatattaaatacatgtatatggagttcaattattcaaaagatactttttcaacaaataactaataaatgatattcagataaaatatattattttcttttcgtctaaaaccttggcacaaatctaagctaggatccaatgaaaagaaaaaagatctaataaaaaaaaaaaaaacttttgttttctaacagtttgagggatgaaagtggattcaccaatgtagtgaagcaacattagggattgaacaaacaacaattaaatgtcccaacacaatcaccagcaggaagctaccatgaaagctatgaaggtggagaaaaggaaaatcatactcatataagccctaaacaaattaatgagtcgcaaattgtggctaatcaatttgttcaagataaggcgggattatacggtccatggatggtagttaaaaagggtaaaaatgtgtctaagacaccaaggggcacaaaaatcaatgttaaagttttgaaagccattaatgcgaagctcctaaaaaaaacagatcgaaaaggggaaaccagattaagattcaaaattgaatcagtaccaagatgtcacgtttattgcaaatgatagctataataattttgtattcattgcaaatgtgatagccagaataattctacaattgatagacatatggtgtttaaagtttgaaacaatcataggggagaacatccccaaatgcctcgtggaaaaggattacctaggtaacaaatcgggtgttaaaaaatttatttatgattccaaaggtaaagaccaaaatggaggcgcattgaaatcaaaacaaaagcaagtattctatgggtggattccaattcaatggacaaccaggataatggagtgagacctaagataaatattaagaaaaaaaattctttaaatgagaaaattatatgttaagtccttttatgtaacttttttgttaaaatatgtgatattttttgttttataaaaattaataataattttatttttgttagttagttgatttactctttggttgatatgtttcctagacttccatgtatatgagaaagaaaaaggagcaagctattggcatcttgcatgcaacaaaatgggtccgcgaaagccaaaaggggaccatgaaattggataaaaatcttatcactcacgtggtgtttcccaatgcggagacaagggctttcattaaagcaatgcaactagggtcattagggtacttcgagctcatcccaagagaactcatttgtcgtaaggaaacctccaattctagagacactagggtaggcacacatggcctcaatacagttattttgtcttcctttattgcttaaaaccctctaataaccatttttcttaatgaacgtccttcgttggaattgtaagggtacaagaggtataaagcttttcatcctaatgaaagttgtgctggaggaatataatgttggtattttgtgtcttcttaagacatatgcaagtggtgagaaggctaagaaaactattcgagggatcaaccctgacaagtctttcgttgttcactcactcctagggctaagtagaaggaatttggtgcctctaggattcctcataggggaacatggatattcttgtaattaattaatatctgcatatgagagtaaacaacaagtctagtgcctagtttcttatgacagtctatgccaatccacatcctatttaaaggatatccttatggacaacaagcctagtaaacaacaatctgttattatatattatcatgatcaattagaacatttttggatagataacataaacaatttattattaaggtgatttacttttgataatattttttcttaatttaaatatacacttatattagtctacaaaaatgtttaactgtttcattaattaattaaattcaatatcaacaataaattgacatatcagtactataagtaaaaatattatttttgggtaaattacaaaacatgtctgattaaaattttatatttatgagagaatttcaataattcaattcataaaagaaaaaaaaagaataaaaggaaaagatggaaaagaaaaataaatagacatgatgaattgtgccaaatactttttatatgttactggcataatcgattccagtattctaagggtgagttaaaaaccttaaatatatgcaaatactgctgcactgtcatagtctcatgactcaagattacaagcttatgatgcataaacataacttactattttgttcacctactcgtacagaaatccgttgtcgtccagcggttaggatatctggctttcacccaggagacccgggttcgattcccggcaacggaaaaatcatttaaaattatgtattttatttgttttgtaaaaatcttgtaattttttctgtgatatatataacgagtcatagtcatgactacttatcccattcatagcatatttaccagaagctctctgcactattgttggtagcatcaaaactagttaaaattaatgtgaaaattatatactttgtgtcatgtgtggctcttagttgaaatattcaccaggaacccaagttcccgcagtattttgaagactactactactcagtggattcaggtaaacaacattccaaccattaacaagcgaaacttgtattgtattgcttctcattacatatctaagacttttggtctaaacactgcagttcctactcacttggatccagttttatatattgtatcagatttttctactggtgtaatggtctttgatttgtctctgcaggaactgagtttgacaatgccacttcaaatgaggattttctcattttacttgctgaaatttttccttcaggaattttgtgatcttagggtgtcttgctgttggagagcaccatattattgtacacttccatggttgtgtgaaggaacaaatattgtggcattgtaattcagttgaaaatcgagttacattggatcattgttatatatttagcttctcttcctttggatgagaacttggattcactacaaaaacacatttgaactatgcaaggttcaaaaccatattccttatcatttctgtgtcaggaaaacttgtgatatcataagaatcactacatctagaaagtttagttaggattgttgcttgttgcaattaaatgcattaaacttcagtttggtgcgtatcttacgcaacatcatgtggatagcgattaatgaatagaacttacttttttttcttctaaaaaattatgttaaatagcatgaaaccgacattattatgagttataatcatcatatactcattatctttttcatttcactttcatttttttttctttccattatattatttattacatctgtcattttctttctctgtatcgtttcctttcactcatacactcaaaaaagttcatccttttcatattattatgctgttatacatagtcagttatctgatatgatgttgcaaaaagtgggatgctgtggaacagggagagattcaagatgagttactcatggaatcccccaaagtgcacttcacaagcagagaggcagataaagttgtggttggggacgcctcgtatccgtcagaggaaacaaatcaagtaatctctcaaagtatttaatagaaaaatactatccatcaaagtttaagtttctatgatttcattttcatacaagggaagacactatccttgtaattctattatgtattatagagtataaacaccctatgccacatcgattcctcattaatcatttcaataaaggagtatttgtgttcttccaatgtgcttacgcagttcttttagcttccaaagtcttctcatattcttcaatggatttgaaaagctcggaaaaattacctttcccaaaacccccacatgcgcccttctggtacaccttcccttcctcatcctccaccatgcacccaatcctctgaattatctctatgaatatcgttggcctgtcaattcaacacaaaacacatttaactaatcaccatcctccaacacaccaactgtaaaattgttaatctaacttttaccactttcaatcagttcaaagcggaagataaataaattcaagatataattgcaattttatctaacaatttttcaatgtcataaactttttatctcatgaaagggacataagtacaatttggagaggggaaacactctgatgaactgctacatcaagtacatccattctgacataacactccactgtaccatcatttgtgaattattgaaagttaattaatagaatataattgtacaacaaaaattttaaaaaaatgaaaatcaaattaaaaaaaaaaaaaaaaagctaacaaagtaggagaataaaaggaacagtttaatgtaaattaagagtgattagttcagtgatagttgaagatttgagttataataaagttgtttagcagggataaaaaagagaaatgtaaataaaaagaagcagaaaatgaggaacctgtcgccaacaggcttagtgaaaatctgaagaagagtgccctgatcatctctgtcaacaagaatcccaagctcctcacagtgtttaatctggtcaacggtcaacacatcagcggcgcgcttgtggaggttggcgtaataggtgggaggaggagaaggcatgaactcaaatccaccaaggaaacttcgctttctcatctctctcagtgtggtgaagatgtcgtgagtaacaagcgcaaggtgctgcacaccagcaccttcgttgtgttccaaatacgtctcaatctggctcttccgcttcgttccgtaaaccggctcgttcagcggcagcaacaccgtctccgagttgttcgccagaaccaccgagttcaacccgctctcgctcgttcccacgtcctccgcggtgaactccgcgaactcgtggaatccggtgaagcctttcaggtacctcacagccggcgcgagctccggaacgttcccgacggcgtggtccagccgccggatcccgtagtccagctccggaaacgacgacgacgacgccgcggcctcgaatcccggcaggaaccaccgcgacggatctgcgtgtggcgcctgcggcgcggcgtccttgtagctgacgtagcggagcaccacgtcgccgtagaggcgcacctccgcgaagccggtgcggccgtcgaggagcactggcggagacgccggctcggcgccgttcgcgacgctggcgctgaaggcggcttccgcgtcggcgacttccaaggcgatggcgcggacgccgaagccgtgtttggcagcgaaggcaaggcaggtggcggcgtcgaaagtgggaatggcggcggtggaggcaccagcggaggcggcggagagagagggagagtaaggagcggagaagaggaaggagaggtcgccggagcggaggaggtaggaggcgtggatttggtttccggtggagagatcggattttgctacaataggcattccaagtccccaagagaatcggcaagcggcgttggtagcatcggtgcaccagaactcgatgtggtggaagcggttaacttgaaagcggtccgatttaggattggttcggacgaagtttttgaaaccaaggagctgaaaggcagtttgattgcacatggtattggaattgggtaatggcattggtgcggtgctggttctgaggttgaggttgaggtgggtggttgtgatatataaggggaatgggagtgtgattggagagtgatggagtgggcattgcgtttgggttgagaataggtggatgaggatgaggatgaggacgaggacgaggaagtgaagatagagaagaaatggaaatagattacgacactgtttcaacgtggatggattggatgatgttgatctacctttcctcgtttcgaactcttatttttgttattattacatggcaatcacctacacctacagcgttactcttacttacattcgacattcatcattcatcattcaacctacgtcaaatccacgtaggattcgactctctcttcttcacacgcttctcttggctttatcacacccttttcttctagaattgtttttttttttttattatttaaaattattatatatttggtatatatatgacactatatacatggcactgtatatgattttgggtacccatttgtgtctttcttttgctaattaataaaaaatattttgcatataagtaataatacagtacttttataattaattgagaaatatgaattatatttatattttttgaagtatattaatatattaaaatatactcatctagtaaattagtatatattctctttatagaaagattgccgttttaaaaaattaatgtgttgctattcttttcagcaaataaagattcgcgcgtactaattaaaatattatggacgacttgaagtaggttgggtccgatgtactttttttattagtagtaagtagtcaatttagtctttaaatttacatattcatgtcactttagttcctaaagttaagaactcaaataaatcccaacaatgtgtttttgggattcatttgtgtgtaaaaagaaaggaaataaagataagaaaatttaagagaacagttaaatgaaataagataagaaaaattaaaagaattgctgtgtaaaaaatattatcaaaaatacgttatttatacactaaaatttcaaacattaatgcactgtataacgttaaaattgtgtcttgaacttgaagctacacatcgttattcgttaaaatattttaacattataattccatatttccaaagcaatactgcaatctaatgtttttttttaagagatgcgatctactgttaataattcataatgaaaggaatgtaaaaatgaaatgtacaaaagagtcagttgctagcagaaataatctaataaacaaatgagtcccacagtttttctctaatggtacaaatgtctaattgaaattttctgtaagaattttaaaataaatcattagatactcttaatttgaaagaaatataaattttattaactatattatactttcataattaatattatctcattccatgtagcggagatttcaatacataagaataagaaaaaatatctaatcttttaaaatgataaataatttaattgtcgttcgtatgtccattacatgaacggttgtcctctataaagggaagagagaacaaaatatctccaaggtttatgccaccgtacatcttggctacggttacaattggaaacaaaatgactacagctattgaatgataattacagaagatcaggggtcactattgtacgtaaatttaattaaataagcttatatagataaaattaggtataaactataaagaacaatcaaaacacactaacaagaggatcatcctcatcttgaggattggagagccaaaatatgtttctgaaatgaagctgcagcttcttccctttcttctaattgccccactttgtcatataccatggccatcagatagaaagcttcagctgccagttcatgaaactgcaagaaaatcaaatcttaaataaaaagcaatagaaagggatttgggtgttgaagagttgtttaaaataatgtgggttaaatgagtcaattttactatgaaatttttttactagttgacttgtgagctttcaccatcacaacataaatcttgaatgtattaagaccccataaaaccaatttgataaacacttatctagtatctatatgcccgaatataatgtatgcctctgcttttggtttgcactggattttcattgtaacagtcatccctacttcattttacgctttacacacacacaatactctagtatctatcacatgcatgcaatcatgtatccaagtgaactttgacgggaggcagagatgcagcaaaaaggcttacaaatgaaaagggaccaatgaaaactgttcggaagcttgtaattatgtaatatagtgttaaagaagtattgtaaattagggatattatgagtagtataattatatgacaattctctactgtattcgtggttctaattacaaataagagcctccactgtgtagtcaagacacacagattcattcacatgacctctcatttttcttcctctcacaagggatttctcaaaatattaaaaggcagaaagtttgcttacctccaaaagttggagttcttcagatgcttgtctcaatgaatctatcacaatctcataattttcaaagactgaaaaagaaattcaaatcagacaagtaagattcagttaaagccccaacaaggggatagaaaaaggaccaacaccctcagaaaactattgacgaaaatgtggggaaactagtttccccctatttgattattatcttttaaagaatcagaaattcggctattgtattgaaatacttgcaaaaacagcatatgtttaaatatacatggatagacaacaaatttgaagagcatagtctaacatcaactatttacagcgacataccattgaagtttgaatcacacagatagcattttgcttcaacaatataggcacgtgagcggagttccaaaccaccatgaccaagaatcattgggaaagctccatggataaggtttagagcccttgttgcatggcttgatccaagagagagccacaactcagctagagtaagtgtggctgaagcttttagaaggtccaagttaaatgagaggcaaaatgagaggcttgctaaagcatatggaagaccaagaactgcattgcctgatttctgataaaaacaaatgaatgaaggctttaaagtaaaaaataaaaaacagtagagaacacaacaatgtgaaagctagggttgggacaatgtagtagattgccggtaatttaggatgagacatagatcaagcataaaaagaaaagaaaaaaaaatgatcatacagataaagcaaaatgaaataaaagtgtttgatagttgatccacaccacatgaaactaacaagtgtgttagacaatatgataatttaccttgtgaatctcagcaagtaaaagaagaactgaagcattctcaacttgaagattgtatttgtagcacatacagaagagggagtgtgccacagaagctgcctaaaagaatcattatatgaaaattaaaagcaatctatacattttttaattgttcaactgttaggtaacagtgattgatttcacccttttgtctccttatggggcaaggaagctaagatccccacatactgtactttaatacataacaataacagcattgcatacagcatgcttgaaatctacaaatcctatgctgttgtcaaatgatacatgtttccaacaaaagaacaatttcaagaatcgaactgtgaatagtgtgtgattgattttctgtatatagtttaatatttagtacatagaagaagactaaaaaaaacctctctgaattgatttgctgcaaccaatgtacgagcatggcgaaggcttgcttctgtctttagttccatatctacaccagttactcgtgatgccaaaacaccaagttcatcacacagtttctgggctagctttaattgtccactacatgatgctcaattaagtgagctgaaattgcagatgctaacacaattcaagattcttaatacaacaaatgaactaggtaacttaccgatgtaaagcatgctcatgaagcagctgcaactttagcagtaagatttgcgattttgagacagatagaaacttctcttctgctattttaagggcgaaaaaggcctctagaaacagagaaaaaggaagaagtcagaacaataaggaactcgaatgggtgatagtggacatttctatccactatcaacaatctcgatgaagaaaatgacaactctgtattaacaaaatgcaatttgcacagcaaataattgccattaagctgaatttatcatattattttttataaaaagttactctggcgacttacaaactattagcaaaagtacaaaaacaagataaaacaaatgcaaatatgaaaacaatcacatacaatattttaaaaaatggtggaattctattcaattttatgcaaccaatctgacctttgtatcctttaaatactgctaaatgttgaatgagctttacatatgctaatgctgcatctgatgagctggggaaaccaaaagataattcaacagaaaattttaacaaaatggtgccgatacagttatttttcataataaacaaaggtgataataacaacttagaatgtgatctctgtaatatattcagctcagaaactaccttgatgcatcagcaaagcgagttgcatgcaccagcgcatttatgcgagacagcggtgagctaatgacaattggaaaagaaaaaaaaatcagattgtgaaatacatacagcaaactttcaagatattaaaaaaccacaaaaattagcattatatgcatatgaaacaagaaatatatctttaatcaccccaagtgatgaaaaataattaaaacaaaacaaatatgtaaaaactgcaaagataaagcatgcaatctgcctttttatttataaacataactttggtaaaatacaaccagggcttaaagaattttggtcaagatggagcctagtgtacccttatgatttatccagctgtgtttgaaaaccatagttcacctgattaaaccctaaaatagaaaaaaatgggtgaaatttgcttctgaatgtttggtaagcaagaccttaatagcaactaaaatgttttacttttactgatgaattataaatagaaatgactgctaatttattttaaaaatataaattacagagatatgtgtgtgtatgtgtctgaatctctctctctctctctctctctctctctctctctctcgtattttgtcttcaattaaagtggataattttcctcttttaaactttggttccataaaaaggaaaaatagtcacttcccagaagcttgacatgaagaactacacagaatggcacaataccattaaaatgtttttgatgggtactgagaaagaaaatcatttgacagaaaatcaatccaagattaagaaaatagttacaatagaagagagactgcaaggataatgtctttccaaaaattcattcaggccatgattgttgttcatcttttgcattcattaccacacttgcactcacccatacataaatgctccaataaaaccagctatgtcatttcttagcagagggtgtgcttgtgtgtaacatctttccaatttattagtttctttattatatatttattccaagttttggccctatttttatatccccacttccattttttacattcaagcattgtgacccatgaataatctttcccacctttcccaacaattgatatggctaacacagccaataagtctcaacctataattatattgcaaagggaaggagtggttgctgttgccaaataaataacagttacattcaaggttttaacataatagaacattgatatatggattaaaattcagtaaaagttagactctcattttaaaaacagcaaaaaaaaaaaaaaaaatacaagaaaagaaatgccagcttgttacagcaagtttttttttttcttttattaataggttagccttaaagcaatggaattttaatcaattataccatgttagttggcaatttccaaaagaaagatagaacaataattagtgtaaccttaattcataatttcatataaacatatctcaacacaaatagcaactttacctgccatataactcccatgcagttgcacgaagtatataagacgaacccaatacttgcaacacagatccaggaattgaggttggttgtgcaatgaattgggaagcattagaactattgccagatccattctcttgacacaaaacaagagaacccgtcggcttttgtaaattcctaagccaagctgtactaaaggcaccatcaattgtcattgcagaactctcatagctaaaatcactaataagatgagaactcaaccgaatttcctgccagccatataagaagaaaatagattaagcaaagaatttaattcgtgtgttctgaaactgtcaccaaagaataatcacaaagatttctacaaccttgcaaacattaactgggcaagtactgagcttcatggaagtttttggaccaaatgatagcaagggccgctggacatgctgcaatcaagatattaccatgatgtaaatggcataagacaaatttcaagtttcattactcactaacaggacttaagatctaatttaagttggtagagcttgaaataagttatataagaaaaataatgatgatatgtaaggtacatggactatggattcaactttaacaaatgagatcctaaaaattattagaattacggtcatatttcaagacacacctaaaccatgcaacatcgagtatgatctatctgatccctaattttcatcttcaagaaatagttcactcaagttgagtctcattgaacttgtattccacacattgtgtctcactctgtcactcctacttacccaaaaatcttttcattccaaagctactctccatgactcaagtttagaattcattctttctctcaattcatcaactacaaccatctctgtcatgtattgtctgcataaagcatacactaaggcactagctattcaatgtgcccaataactacatccaataccaaggtaaactgatggaataatggaaattgtaacctattatgcttatatccctattatgttttatcccgcatatggtaatgttccatcccaaaaaagtgattgtttgtttgcaacccggaatgctcaaagcagtgctctgaacttcaacatggtagcaatagaaacaagaacagtagcatgtgctgagacttgagagaataaatactgggttcgtacctaagatatagatcaaatgacagatttaggctctcgatcctttcagggagagaaacatttttcccaccccaaaaaatgctttcttgcttggtagggttcaaacttaatgatagattgaagtaaatgtatcatgatcaaattttaagcaaatttcaatcctaaatagctaaccaatcagatatcaaggaaagtccagtaccacatacaaaactgtattacaatccatttaacattaatatggattcaaagtcaatccttcgctaaagccttccataagacttctagtgccatactggcatatactctatctatctcaatgatgactatgcaaggatctttttgtttccttcagtatagatacatcacatcctgcagtagacataaagctttcatggttgacctccctggcataaacccaatcactctcaaatgcaggtctaatcttaatcaactcactataactctttctcacgttccacagtgtaactcatgaacttgattatctggaatttgcacaattccatgtctctcctatattcttatactaacaggtcaatatatttgaggcttgaatattttaagaagctaaagccacaacaaagattttacattattgcttaggattcataaagaaaaagtactagcagtataaagagaatgtttagtttaaagtagtcagaaaatttcattaccgttagatcaaatttggccattgccagatgattggaagccaccaaccgttttaactttaaactttctgctctctttaaagaacctctcaagagaacaaacaattgttgctgaacagaaagcgaaatacctatacttgtaaaaggtgagtatgacgatcctagtgtcgcagctgtacttgggatgccattttcaaacagcaagtttgaaatagctgctaaagtatatgcaagacaggtatcattactttgctgcacaaatgaaaattgtcagtttttacagcacaacatatggaaatatttgccaacaacatttatgttgccaggtaccccttgtagcatagcatgcacaggcaaacatttgttgtcagcttaggttttgcaaataattggtgaatacatgttcacaattttatttaataaataaagcttatttttatatgattacctgctgagaaacacgaaccgcctccgacaaaacctaaacataacaaaccaatataagtgacaccaaaaaaatgtatagtattatattagcttaatgattagtggagtacaaaataatacaaattatagaagccttgaggattagaaaaggtagaatgctgagcacgtatcaaaatcaaaatgctaaaaaaatttacctctaaagccagctttggatgcccaaagtgaaaatgcatcatccccaaacataataatccaatttcatatcttccaaagccactaccactaactgaaggaatataatcaaatccttcagtccctgcacttttgtccaacaaataacagacaagttcagttgcagaacataatgttctctatcctttttattggctattaagtcactaaacccttaagggtatgggcacaggacaaatataattttgagatctataatcaaagcaaaagacaaaatctatggatgaaggaaaaggtttacaatttatgtagggaaactttaatgaattaatgtcaaattgaagataaagagaataaggttattagaaaaaagtagaatgcaggcaagacaataatggccttcagtagcacgcaaacagactagcaatgtcaacaattttgtgggatgagagtcaattgtggttattgaggtagcaatgaatatcaattgacaatgaactgccacaaatgaatgatgcattatttctgcttgctttatatgtaattagtcatcaaatgaacccaaacattggcaatgccgtcaaagagattgaataaagaaataaccgctcaattacctgtaatcaaaatagcaatgaagattctccaaagcagaaatataatcatcatgagaaagaccattcaagtagctcaaaaagtgaacctggattgaagtgaaagtcaaaatctcggcaaaaatgaaaaaaatctaatatattgaaggaatagtattaaaaaaatctaataaacttacccgatgaagttcaggtgccaacttttgtagttgccgtagaatgatttcaagcccattgaaagatacagcactaccattcctgcaatatatgaataaaactttaaatttaatataattacatgcactgttacagttaatttaaaaaaaaaaaaaaaatcagtgaagttctaagtttacaagttgttacttttcaatggtatcagcttgctcctgcaagtacccttgtacctgccagtttgtccgcagaaataccgcactgctgtgatcaacatctcgcagcatgttacttgaagggtccccataaggactagctactctaactttctcactctgtttggatactgaatcagcaggcacatcaatatctgtgcatgtgagttccaacattatcagggaagttatgtcattgtgtcaaacagtgtttccaagagcaaggcataaacagagaaaacccaaaagagaagtgcaggataaacaagtgtagaaacagaaaacagatttggaaaattggttaaatatcctggtctagatttttcaagtgctttcaaaactacagaaaacactaaaagagcagcccaattaaattagatccttataccatcaactaaactcagaagagtgttgggtgtatgaagatggaatggaacaatttcactagcctcctttcttgcttcaatttcttctgaaaccttttcatagacaaagttctccaggtccatattctcatattctgaatatgtctccagattactactagaatcatctaaaccgtgttcttcataggcaggacaatttgagaattcttctttacaatagatcccgaggtttgtcaagagatgagatacaccctggacacccaaattagaggttatgaggaggataagatttcattttaaagaggaaaagtgaaaattacacatataaactaagcatatgagaaaagagtaagaaaaaaaaattaaccagagactcaaaattgtatattaaactcctaatagcaacatgctcatcatgaaaacaaaggataataggtgctgagccccactccacgaattttagtaatatcaatgtaaactcattcaaaggtatcatttagagtttacttcagacaacaatactttgttcgaagcacctagcaatattatggagcttcaaagaagacaacttcacctccccccattttttttttgacatggataatgatcatataaatattcaaacaatgatcaatttaaaccatcttaagaatgcagaaaacatcatacctcaaacgatagcaagttaaaagcaagaacacaacgccgaagaaatatccccaggttactgttcatgtccaaaataacctggtcatcttccacagcacctgaatcaggacccccaagtattcctgaaccacattttactatcagtaaatatgaaaatttgatctaacgtataagcaataaccaaatgcgctgcaacttgcaagtaaaataaaaaggataaaagacggaatctaatagaagcctggtccagtttctatcagaatcaaacaagacagaacatataaaaaaaaaaggtcaaaggctagcaaatattaaagctgatcaactcacctcgtatatcgctaaaaaaattaaacaaatcatcaggtgatgacagagatgatagtctgctcatcaactgatcaataacccaggaagcctcccagttctggctcatcattctcaattgatggatgagttcatccaattttggctccaagatataatcgcaggactgcattattaacaacattttcaacacaccagtatgaagaaaatgtgtgatcgaacactgaattagtaaaaaatcccaaagaatatgggaatgctaaaaaacgattaaaatagcatgcccattccactggcactacgccctaagataactaagatcctatttgaatagactcttcaataagagaaagtaagaaggtaagatgaattaagcttctcccataagttaagattagcttataagttaaaattattagcttttggactttggagaagctaaatgagagagcttatataacttagccaatgcataataattttaacctttgggaaaagtataattcattctaccttcttaatttcttctgctacaagtatttactgagaacccggtaagagaaaacagacaaggcgagaagctaaggaaaaaaaacgagcactatttagcacaagctgcctgcgatacgactaaaccaaaaattcctccttccagagtgtgataagttcaaattcaaattcaaattcaaaatggtagaattgattgaaatgcaatttcatttgtccagaatgaaagaaaaaaaagtggtgaccttggtgagggctaataagaacaagccaaggcgattgtgctgagcaacggaagcgaaagggaaggggaccgatatctgagcgggtggagcgtagatcttaagaagtatgcagagtgatactttgtgcggtgtgattgcaaacgcgcccggttgcttcaatatcccacccattagttatcgtcgcctgctttctgtttgacaaaatgctgagctgattgtgcaacttgagtacagtgatgttcacttcgattcgatgcctgatcagtgaagtgaaggatgaaggagcaggacttggatcagtattgctgtcaattaatttgagactgtaagtggacgtttgtctagggtttggtttttgcttttacaatgaaaaagcgccaactgaaaaatgatactctgtatttaaattcagaagtacacatgatacacgtacatccactccctgtattatggctcaataaaaaaataaaaaatgaaagactgaataggaaaaagagaaaggtgggaaaaatattgattttcagaaagaaaaaaataatacgttttctgctaaactatatttttactcatttgtcattattttggaagaataatattgacttaaatttgagagataaaagatttttaaaagtaaaggatgaaagcaaattttaataaaaaaataagaaatttaaaatatattttaagttagatttttttatataaaattgatttttttttatatacactaacaatctaataatctaatgagaattgtaaccaaaaaaggttggtgcaatgagtgttataaatattggtccagagtggtcggtcgaataggtcagatcgaaaactagtaacataatcgggtcagtttcgctttaggactggttatgcagttgatctgaattggtccagttaaatccgatcgggttggtcaccagatctcagttgaatcggtccgatccagctagtttaaaaaacaatggattttttttttgaaaaaattggattttttttttaatttgaatttttgaatatggatctttcttactcagaaataatattagttatatacttatatataatagatacatatataattttaaattttaatatatgcccggtcaaaccagagccatggtccaccgattggaccattggtccaccgattggaccattggtccaccgattggaccattggtccactatctcaatcgagtcaatgaccgaaccaggttttacaactatgggtataatggtataagtcatgctacattcacatgacatgagtgggatgatccatttaacggtataatatatgtttgattctcattatgtgtacaatttcttgtttcaacgacaacaattattagtctctttgagggacacccttgatctctgacccaaaaccaaaacaaatctattgtgaattattaacaaaagtaaatcaattatatcgagaataagatctttatatcgttaaaaatcccactcattaagtaagaaaataaaaagcaaaataaaccatttactttgtttttgaagtatcatcctctctcttaaatagtgttaaactattgaaattatacaagtactccctttttttcaaaagcaaacttaagaacttccattgatgatcacctgttgaatacaaaaaggtaattgatctataataaccttggcttaataaaagaaaaaggaagagaaaagtttatattttcagaaaattatgtcgcaaaagtgttagcgacggaattagcgacggattttgcgatggatttagcgacggccagtgagtggcgccgttagtgtggaaactggcgctgttagcgtgggaggtgcgccagagtggcgcgattagcgccagatatggcgcggttagcgccagaatgctccagaaagccatttctttcgaattggtggcgcgattagcgtggggtgtggcgctattagcgcgggaacgcgtacagaggccctataaaaggctattttcgcgttttgggagagaaaaactgtttctcttcctcttcctttgccatttctgccatggatgaggctccaagcttcatttcttcatcttagttcaccaaaactcagccctttaacttctaatattgtgggaaacacgttgtgagctataatccttcctctttttccttaaaacccctcaatcagagaaatccctttctcaagggaaatctgtagaactcgagtttggctaggaacggcggcgattcacggacacccagactaggagaggtggtccaaaggccttccttgtcatctttgaggtaagaaactcgagtttcaccgtttaatttgtgaattggggattctgatgaatagtgacccacttttggtagagctagaattagctctgggtccagttgagagatgtgtttagaatgatgagaggaggaagaattagcttttagtttgtgatttggtgaactttggttttggctctaggttgtgcatgtgtgacttagactgagtcacttgaattgagacatgcaagagccatgttgttgggcttgaggtgcctgtgaggccttgggaacggtgtcttgtgattagaccgttcaagccctatggaatttctgtgttattgggtagtgtgggctgtgatgcccgttgtagatggctattggtgagtctggaatgactctgcagccatggtggatctgtgatagaccactgaggatctatggacaggattttgatggatgagcctgagaaccttaggttagataacctgggttgttggaaaggactgaggttcctttctcagaggcagttggtgactgcttaatgagcttatgcatgcttatatgcttggatggtctgtgatatgtgtgtttgcatgccttgatagggcttgacacggtgggtgtcagagaagcagaccatcatctgaggttgaagctgcaggcacagcttaacaggtaagctcatcgttctgggaattagcccttatgcttgtttgccacccaagtgggtgatgattatactccatgtaattgatatgtatatgtatagattgctgtgtaaggccattgtggcctaattctgatgtaagatggactggacaccgggatggtgtcattatatgaatgtatgatagcctagtgtgtgctgggctgaattgatgaaccctaggatagacactgagaaagtgtgagggtatttgacacctgtggcttcaggtgtggccttgggcctgagatgtaggaacactgtgaggtgttccatgactttgatgagatacagatcagaaaatgatctgtgatggaatctataagatactgagatggtatcgggctagttgaggttccctagccagaggaagagttgaggactccctggaatagctgagattccatgggaggtgccactgctctccgtctaaagacctaagggtggattgccctgtatggatgttcctccttaggcagagatgatgaaagtcctgcgtgagtatcctcaggtgattatgcagagattgataaagaccatggtggtggtctgtgttgaggataaatagacactgtgatagtgtctgagttctgagattctctggccagtagaatagagtcctatggtggtaggacagatggtatgtgattgaaagtcctaagagattgagtgcctcctgtgtgagatgatctctcttaggcatgtggttgatgaccctgagggatagagtgcctccgttgtgagatgatctctctcaggtgagagattgatagtctgagggatggagtgcctcctgtgtgagatgatctctctcagaccgtgattagaagtcctgagggatgagtgcctccgttgtgagatgatctctctcaggcagtggatctagaagtcctgaaagatgagtgcctccgatgtgagatgatctctttcaggcatatgttgtgtgaagtcctgagttgagagattcctcaggcagtatatgtgaagtcctgagttgagagattcctcaggcagtgtatgtgaagtcctgagtgaagagattcctcaggcaatgtgtatgaagtcctgagtggtggactcaggccatgcttgatatatatatatagcattggaggcggtgcctctctggtatatacagtgtctagtgattgacactgatgattaggtacctctgtgagatctctgtcagacgattataagagccgatatgagatattgaagccatgattctggcttggctctgttagatggttttgagatggctgtgagagccaggatgaggtgtgatacctatgatactgagagtatctggttatgttgcctgtaatgggttatgaaagctaggataatttcctaagctcgtttctgctttggttttatgtgtatgctttgaggtgaaccagggtaagggaagatctcccagaaccctgagtttactgagacgtttgtctcacccctgttgtgggttgtggttttcaggtgtttccagaggagagaagatacctcagggcagaaggccctagctgagagtactggagctggtcatgggctgcagatgaagactagaagagtctttagtttgatctctgtcatgtactctgtatagagatagggtgtaagtgtacacccattgtattgtacatatatgatgtatgacctaatatggtcttgttttgagtgtatatgtacagtttatgttgttgtataagagtacgtttcctcctgagtctctatatttagatgtgtgtatctgcctgtgtttgtttatttctgttcatctggatcaacaggggcttgttttctatgatgctttgtgttgagttttatattccatgcataatgaaatcaagaggatcgattctatcgcttccgcaccgcgtttatgtaacgctgatagcgcgcttatgatattattaatgataacacgtccggggtgttacatgatctatactttcaaaacttgtgagactagcataatcggttgccacccttgcaatggaatgagtgacaaagtctgtttgcctcttgataaactagatcaaatagtttggattgagggagagtatgtatgcgcactcttgaataatgacacaggtcaaaaaaatcttgggtcatactatagatcttatctacaactagcttactatccatttcaaaaatcactctacaaaagtgattctccaataatcatttgagggctttcaatgaccccaaggcctccctttcagcaataggaaagaactgaccttcactgtcaaaaatcgcaactttgaaattgccttggttgcctctacaacaaatgccccaactagtgctattaatatctacatggaaggcgacattaatgttgttgcatttgacgaatcagacaaatattgtttagcattaaaaaatagtcttttaattagtattagcatatataattattgaaaccttttgtttgagtccaatcacacaaatattgtttagcattaaaaaataatctgaaaagctgttggacgcttgttttcccaagtgagcttgttcctaccgtgtcatatagatcagataagagtagcattgaaaatcatgctatatagttcctttagtattgaacatttcttcaaattagtttccttaatgttagtaatattttttataactaaattgattgtttattcattaaaaggtgtatgaccttttttttccccttctctctttctctatttttgcacaaaactttttgtgtcttgtaccaaaacatcattttccttctcctaaaatttaattttaccaaaacaaaaatacactttgtttggttggtggaaagtgaaggggatgggtggaagatctattcttcaaatttttcgaaagtgtttctgggagtttttcttcaataaaaatgtttttaagaattatttttaacatcttatttgtttcaaaatattattgttgtttttatttttaaattaaatttcaattttttataaaaatgatcaataattcaaaatatttctatatcacagtataaattatttattacaaatttaaaatatactttatatgtttaaaactattcattaattatgaattttatttataacatataatataacataatttatacatttaaaagttattatttattataaactagttatatgaaataatatttttcccacccatgttaaaatactagtttattgatgatataaaaatctttatatttttttataagccaagtgatgtattattaatagaaagccaaactgagaacaagaagtgtcaagtgatgtaaaattattgatattatcaatgcaaactcttactttaattaatagtgtaaaaatatatacattgaaaatgtttaaaaaacttaaaatcatgtttttttaatataaaattagtgtttaattttgatacactcttagttaaaggctttttacaatataaactttttttattaatttttttagtttttaaattataaactgattataaatcattttaagtaaaatttcaaaataattattataaaaatcaacaattttaattatatacaacagacgatgataagcataataaatatttacactgtggtatcattctaattaaattcacaaaataaatttaaatatgcattcttaattgtatttcattattcaaaattaattttattaaaattattaatcctgaccaacacagaaaaaagtgaagctaactgcacaactgcaagtcagtatgccaaataataacctaccggtctttcccattaaataatttagtttcctaaacttttttttttcttctttcaatattttcttctaaaaagtaaaaaacaaacactcgaaaacgcaaatctgggggaatatcacccaaaaccctttgtgtttgagcttccgacaaagtcttgatctacgctcatggcttctccggtaactcatcaatcgccaccttctctttctcactctcgttgcgtgttgtgtattttgaatcgttgttaataacactgagctgaatttgcaatgacacagcgagctgcagaaaacaccgagaatagcttggagaagatcaagcgccagctcgcttccgcttccggtagaaacctgttgcaaggaccacttctcaagagatctgaaaccgtaattcattcactccctttatctcaatacctatttcctatttctcacttcaatttcactttattttcgcctttactctttttcttctcccaattccaatttttaatttcttattcgatgttctgttataattccaatgcgttctgttttgttacgtgttttataatcgtttgaatagccaaatgttattgattgatgcttttagaaagaaaaagaaaaaaagctagttcatgtaagaatcgcttttgtgttcacagctgagaaaatggaacgagcgttgggtcatcttggacccgacaacggggagaatggaatacaagtatgtgtttgcatattggtttctgtttgtgtggggaaacggaaaatcactttgattactgatcttctgtattgttttgaatgttttccttaccttaggataagacgaaatgaaccttctgttaaaggaacgattatatttgatgccaatagcaccatcaccatatctcctgtgaatttccagtaagattggtgtttttaacataagcttattttgcctagtttccagatgtttttatgaagttttgttgcatgaattttcttatattgacatggttgtttatttacttctgtgtattacagcggacttccaaagtacgatgggtgctgcttttgtatcctttttatcgcatttactacttatgaatcatcattttgcagcaaattgatggaagtcactctgcttgttaccttaattggcttctttagatattgggacaccacagaaaaaggattacttcctctgtgcggagactcctggtgtagctagagcatgggtgtcaactttacagtaagttttataatcttagaatgtaggtttgaacctaattcaacccaaaaagttagctcatggtgtgaggattgcccctcacttatatgttatattttgacattatctttgaccaatgtgagacttgggtttttccctacaccccctcacgcttagcacttttgaacttggtgtgtgggtaacatggtggataaaccttttaatggatctaggacatcttagaatgtgagtttggacttaactcaaccccaaaagttagatcatgggatgagggttggccctcacttatatattatattttgacactatctgaccgatatgagacttgggtttttcccaatataatcccacacttttatctcccatttccctctgggccaagttccaaggaatataatcttatcctttttattttattttatgttgtcgaatgtatgagtatgaatgttataatccctttgtatttcaaaagtgtataaagaggtgtagcttacaaatgaaatactgcatgcttgaacctaaatgtactaatgcatttgttttgagttttatcatttattttctattatcttacaaaactttgtttactttgtcatgtttcaaattattgaggattcataagtcataactgcagtccttcacaattttctaactcttttgaacagtgtgtttttatattcatttgaataggcatttgcttggaaagggagacctgcagaatactaatgtcatgtcataattcagcctttatatttatgttacttttgttattatttactataattatttgtctgatgttcttgctttccgctacagtgaatcaatttgaatgattgctggatcatttctatttcagatttcctgtctaatagctgtaattattttgatgtctgatttattttatcatctgacattagtgcaactcagttggttctaaaagcgcataaagaagctgtgaattccttaagtgggaatgggtctacaaaattaggaactgttgcaacagttgttgctgcatccaattcgacagccttggaatgttcaaaagaaatcgaagcagcaatgcagatttctttgcgaaatgctctgggaatgatgaatcataggactactgatggtcctatggatgatttaacaatcatgaaggtacaatctagttctggtttattctgtctttcttgtgctcaaatgtatagttcagcatttgtgatggtgcagcagagaactgcagagttatagctactatttttttttgggtagccttttatatacaaggactgatttggaaatcttttctttttgtgcaaggactagattaaacatgtgtgtcatgtacagtgataaaaagtttaattaaactttttataataagctaaaactctgaggaattttttttaagtactattcttagaaggtaaagtgtgttttttttttttttttgtcaaagcttaaccaaatgcacccttaactagatagttactagctataacattttaatttttttttttttttaatgaattttgattgtgtgatgctttgaactaattgtcgtactttgtatataatgcattcaataatggttgtggcaagatacacaatatggttgaaattgaattatgataaggcttctttgtacgccattgtcatgtattaaacaaagaaatttgtctttccttgtcatggtgttgtttgaaaatgcatgaattactcctttgcttttggggttaggggaggactacccttttcatcactgtttacttggctaactaacgtttgcagacttttgatttatgttcacttgcttagaaaaagaaatgaaagcaaaaaaaaggaagaaagtatattggggaatatcactttttcctcttgtagtatctattaaagggggagggggcgtagtggccaagattttgaagaggaaatgaggatggtggatataaatagagaatggatttgttttttaatgtttttatgtgggtatttattgtcttcttgggccttttggttctgaagatgctactccactctacaggaaacacttagagtgaaggaaaacacatatctgtattgcggaatcggcaagtgtaccgatcgttccaagtaataaagtaaataagtagagtatcgtctccacgaggattgaggcacgaattttattgtaattactatctttaaattggaaggaataaaatttaattgatttatgatttgtattatgttttgaagaatttaaatgacaaaagtaaattgcaattgaaataaaagatagagttgattatgtttttatgatttatgggaaagaattgtagtcagagcacttaaccttattatccctacttcctttacttggattaattactaaattaattattctaaatgtttagacaatgtatctttccattaatctagtaagccctaatcccttagtgactttaaccctttaattcatttaaaatcctaattccttagtaatttctcataaattaagcattaagaaatacattaataattctgcaatcatacatcctatccctaggtaatgtacgattgttactttactcttgtcagtcattaaagccccaatattcctattgtaaaccctaatcctcagaactttattagaatgatcagccctaataaagatataatttatgaaaacagagtaaaatgaaacaaattagcataaataataatagaaatcaatccaattacagaggagttctcattaggttttggccctaactataaagagagaggaatcagctagacatagttatgtctgactctatacaatggagtgagaagaataagcaagattagaaaagaagagtatgcaaacccttcaatcttggatctttcttgaatcttctttctttcttcttgatcttggtgatgcctctttttccttcttttctttttcttttttgaacgtcccttccctttccattatgttcctatttatacttaaactataaaagccctaatagccttcagtttaatgttatctttaagctaatttgaaattcccgtgtcgctggcgcgactggcgcaagatctggtgcaactggcgtcagcttccagtaggtctggcgcgatcagcgcggttggcgcgagacttcagaaatccttagctctttattttgcttcttttcttccttttcttggctcctaacatcaaaattgcataaaatcagtgataaacacaataatgatgaactttgtacttattctagtatttatttgatattttatgcttagtttcttaatgaatttaccctaaaaactacatatgctaacagcatatcactactccacaatacaggaaacacttagagtgaaggatgaggagctacagaatttgtctcgagaccttcgagcacgcgattcaactataaaagatatagcagataaactctctgagactgctgaagctgctgaggctgcagcatctgctgcttatactatggatgagcatcggagaattgcttgtgcagaaattgagcgtttgaataaagattctgagaagcagcaagagctgtttacacagaaggtatgccattgtgctggttcatttgaaaatattttttggctgatggaaattcaagtgattctcgttaaactgctttcgacaattgacccttagctattactatgtatgggtattacttgcaatgaaattgtcttgaatgttcatcttgtcttaaattgttttttttttgtagctgaaagagtctgaagaaaagattgtgggcttaagcaaagaaagagagcaattaatcaggcagagagatgctgctattcaggaagcaaatatgtggcgttctgaacttgcaaaagctagagagcatgatgttatcttagaagcagctgtagtaagagcagaagaaaaggttagggttgcagaagcaaatgctgaaactaggataagggaggctgttcagagagaatccacagcgttaaaagagaaggaagagcttcttgcatatgtgaatgtactaaaagcccaacttcaaaggtctaatgccttattttcttttgcccttgctttttgttttgttaaattagatttgttggctacttctgttttcccacataaacataaagatggaaatagtatatatcaatacctattgaaacagggaaatggaaggagacttttgatggtttattttcctttttatttcattgagtttgaatatgtatatcagtatgaaatgtggagcatcataaaaccaaagttgacagcagatatttttctttacaacaggcaacacattgatacaactcaagtttttgagaagacagagtcatgctcagatacaaagcatgttgaccccacggaagagaatgtggataaagcatgcctgagtgtttctagagccatccccgtccctgcagagaatgtagtccacatggcaacagatcaggtgaacattcaaccagttggggataatgaatggagtgatattcaggctacagaggcgaggatagctgatgtaagggaagtagctcctgaaactgatggaagcagcttggatattcctgtggttagccagccaggaaccaatcaccaccatgaacaaggagctaactctttccatcaaccctgatatgttattcacaagtatacaacatagagcaaatttcaactttaggcaatgtaattataccattttgttggatgagcgtgtaaaccatattgttttcattttatcattgcctaatcaagctgtgttatgacctgccctgaaaagtgaataccttttttctgatgtaaatataatgtaatacaacacgagctgtccggtaaaccatctgtgatatgtaacatttaatcaacgaataaaaccctttttttatccacaatgaattgaggaccttcaacaattaaacaactgagctttttcgagtcccatgggatggagtatcataaatattgaagaattgactagtaaaaagcccacaaatgttttacgaataacttgatgtagtactttattgcgtgactttctttagaatcattgcaacctgacactccctcttttcacctcctcctcaagttagagtggtgcttcatacaccattactcatttcttctacaccattaatttacagtgcatttcccattctgcccttagctttttaaaataaaaaaacctctccatttcccttctctcactcactgttcactgctccccttttgtctccctcacttcatccggcatccattgcgaagcagcttcgtttgtcatttcggtgaggctttggtggtggcattgggtgggagcatgctctgcggttggtgacgagggcgttgaggtaagtttcgcgttccctcactggttttttcttggtctgttacgtcaatgggagccttggcctgatacggattcagtaatccatacactccatatggattgaccaatccgtataggttttacggattaggtaatccgtgattctcatatggattgaccaatccgtatggggtgtacgaattacctgatccgtaaacctcatatggattggtcaatccatatgaagtgtatggattaccgaatccgtaaacctcatatggattggtcaatccatatggagtgtatggattaccgaatccataaacctcatatggattggtcaatccatatgagatgtaattttttaaaaatggttttgtattagtgtgtatcccaaagcacaaagcccaatttctaaaatgatattagtgtgtatgagtgcgttgagatcccacactaactagacgcatcacaatatagtccttataagacttggagaatgcttacgtaagaagccagttttgtagggtagattaggttataagcccaaattctaagacatactatatcctaaccccctgtcacttttgatgttataaatgtatgagtatttccactttttggtcccaattattcttccacttcaaatataaatccaaatggaagcaagtaatgtcaaatagtgcatacatttattgagataggttaattttcttataatttgcattgtgttagatgcttattaggctgtaaataggaatttagcttaaacgtttgagaagcttttattattttataattatgaatttgttattgaaacaatatctaatgtttgatttagaggaacaatttaggtttaccaaggcaagcttttattattttataattgtgtatttcttattgaaagagtatctaacatgtaaacaaatgttgtacagcttatggctaagactagaggaatgcgtcaggctcttggacgagatgttgaccgagcaagtggtagaaatgtcggaggtaacaaagataaagccactgagatgcgtaggccgataacattgtatatacgcgggacacacggccaagagatgcacagcgaaggcgacatggatgacaataatgccatgtttttgtttaaatagtttggacattattttttgactttttcatgttggacaattgtgaaaatcatttaagtcaacatgtttagtgcagaatttcattgatttagtatacatttgcattcgactcatgtaatgattggaccactattgagcttcatttaaacagtgagtagcccacaagcacgccgtagatggcaacaggcacttgtttcttaaaaaaacctattacaaatacaattaacttcaatcaagtgttaaataaataataataatattttaacatattatgaaagtctcaagaacaccatgttaaaaaaaaaagaatcgaaaaattaacttattgtattgtattttctcaacgaaattatttgtcaacttcaaatcaatctcatttaaatatatattttttgattttttttataaaaaagtaatggtataagacatatggattacctaatccatgtgacttatacggattgaccaatccatataagtcatacggattggccaatccatataattcatatggattaagtaatccatatgagtcatatggattggtcaatccgtatgagttatatggattgaccaatccgtatgagtcatatggattacctaatccatatgaatcatacggattagtcaatccttaagagtcatacggattacctaatccgtgaattccatacggattaccgaatccgtacgctaccatcaaacaacagagacccacctctgcaacccgacaccgcttcacgaccttcgacggccaccaccacgacacaactccgacgaaatcaacacaatgtcaccaaaaaccaccaatgcagagcgtctctagcaaccggtggcacaaaaacgaaatgaacacagcgaacgaaagtgggaacagtaaacaaaagtgaaaagctttgccaaatattacaggaaagctgccaggggtatatttggaattttttaaaaaataatggtgtagaagaaatgagtaatggtgtatgaagcaccactcctcaagttatgccctttactgggataactattgtattaacagctattttgtttccaccaaaaaaaaaaaaaaaaaacagacagcattgatgggattgctaagtgtttcacatcacttcccatttccaacccgaatttatcggagcgttgttataagtgttgacgtcgaagttatgtatgcgtctagatgaaaatgaaatataaggatatcgtttgaattggtaaaatgtggaagaaatattatgaaagtgagtgaattttattacatttttatatcattatttatttatttatttaattaatttgagtgaaatgaaatataatgaagattttgttttgttctatcataacgtatccaaaaaagttaaattagacccaatgaattttgaggacaagtttgtgttatcttgtgttatttcaacccaattttatgtcgtatattcaacccaggaagggcagctgatggtgtggtttttaggaactcccttggtatgttcattggtgcttttgttgagttctatggggtgtcctcctcccatcattctgagttgctggcagccatgagagccattgagcttgcgcatgataaagggtggcatttcctttggttagaatgtgattcgactttggaaactcttgctttcaagtatcttaacttggtcctttggaacctccgtaatagatggagaaactgcatgcatatataattatatgcgacttctaagatgaattttcgcatctcccatatttttagagaatacaacacttatgcaggtaagttaacggccttcgaagtgtatagttctaatttttgttggtgggacttttccccttcttttattttagatgatctctatagaaacaactcttgtaaaacttcctataggtttcatcgaggaatttaatttttggtaatctctgtcatgggttggtttggtccctcatgttttttggtataaactgtttagttttaattctatgatctctggtttgtgggtgttgggttgcgggtttggttccttcttttggagtcttcgcctctcttagtcccccagtctctcatcgttatttttgaaaaaatatgtcgtatattatcttaaaaaatataagtcttttgaaatcttttgatttaatagataatattttatataatgtaatattatatttataaggattttatttgttttaatatatatatatatatatgtattattttaagctttttttacttcttttattcaatcatttaactatacataatgttaagattaataatttaatcatttttttattttgtatatgtctagtaatattgctgcttgtgaattaaaagatttaaataaataatccggttataaaataatgtctaagtttccttgattgaagttttttttttctcgatagaaaacaaaaacaggtataaaaaatttataataattcaaatcaaataattatgctaaactcctatgtcttgattgaaatatttaaaacatcactttattgatgtccactgtcacctgttattatacacgacgggtaaagttaattaaatcaaataatcaatgctttattaattatatttagacacacaaataaaaaggaacaagaattgtcccctaatgagattgataaaaaagaatagagggtaccatatatatgacaaataatatcaaaactataacccgttcatacaataatatattttgtcaaatgggccaaagaaaaaataacaaaatactcctatttggtcaaactgagagatattaaaactgttactgttattagtagtttaagcatccaaatgctcttaaaatctattgaattctttacaatgatcagaaaccctggatggatcaatagcaaactgaaccacagatgtgagatcatcccaattctcattagcaaattccacattattattctgacgatgattccaaaaacttgagtaagccaaggatgttggagcctgagctacattgcctaattgacctagaaataagtggttacgttcaacgtcaacatgtccattaataactggcttcttttcattttgttgaatgagttgtggggatgatgagtttctgaaagtcaagtatggcttgcagttgtcagattctaagctgcatgttttggaacttgaagaatttgtggggtgatttggctcagtgattggtgctgccaagtctttcaaatttggtgtgtacttcttgtaagttgggactcgtttgaatattcggcatagcgtccacacttcctgcgaaccccataaataaaaagacataaaaaaattaagacacttaaaaacttgcaaattaaacaaaagagacagaatgctagagttgacatggttgatcgcattaagtgatgccacaaaatgaaataaatgcaatttatgtaacgctgagatgagaaccacacaaaattgtcgaagtgtatacaatatttaattagttgcgagatttcttgttacgtaaaccatcgtttagtatattaatatagcacaatgttaggtactactactttttattttttcgttttgtccatcaatgctttggtataattgaacgggaaaccaacaatggaaattactaatttgatatgtagtacttctaaaaataactaatttgatatgtagttcactagttcataataaaggtttttaccctgtcaaaaaataaataaaggtttttacacgatcattaatttttctacaattttttttttgataattacatttttttactaatttaagttatatggttaaatgatagtgtactattaatttgattgttttctcctttctttaattactattaaatcccattcggtcaattcaaaagagcttgacgagccaatgacctaagaaacgtgtcatcagaacacaaattagactagactgaacatatataggaaccaacatatatgttatgaattttaatatgttaattgtatttatttaattctataaatgaaagtttagggattttagcttaactaaaacttcattataatatattaattataaaacaagatattccaagcatacataacatatattttaatttttttagctaataggcaaatagtataaacttaatttgctgtacaagaaagtgcaacacccgtatcctgacatataggcagtggagccaaaatttctgggtatttcatgcattgtacatgccatgtgtgctagaagtttgagacccaagattatttataaatattttttagtaacaaaatattaggtgaagtaactaccttaattttaagtttaggtctaaaatcataaggaaggctaattaactactaggaagtatagatacaattcgggatatatatgcataaaatacataacataaaaaaatttgaaaattacagaaaacgttgcagctataatatagtatgtaaattaatataaagttaatataaagtaatgatttaaatcacgagaaaaaaaatccatgttttaaaaatgaatacaaatcattatgaacataataaaatataatacaaaaaatcatctaattgttgtgataagtacacaagtttgaaaaaattttaaaaaatacaatattacaattaaaaatattaataaatattcgacatggttacgtatacagctacggtacaacacaattattatttgaaagtgtctgtccttctttgctaaattatttcagcctagaagagttgatgtgattatttaataaataaattggttcatgtgtctttatctatatgcatttctcccttttggggtctaataaacgtgcttatgactttagaatataatttataagtacaattgtttgttagtggtcttcttgagtatgaacaagattctaaccccgaatctcagaaactgttgtggtcgtttgactatgttatctcagatttttctttacatgctgttctagatggtttatttcctattacaaattaatattttatacttcttttaaatacatgcaacataaaaaagaaatttcaaacgtactgtcttattagattataaaaaatagtgtatgcacttatgtaaagattttttatactgtatcattcaattataaattattattattatatatggtaaattattgatttttataaagtattgtaaaagtcatttattagttatgatcagattggttaattatatatgtaaaattttgtaggctaacgatgcatagatattaacgaaacaaagatcgagtaacatatataataattgacttacagcttcttgaacatcattggcatcattagcttgtggattattgctagtttttccattgggtgggaggcgaaactcgtgcatcatccaatcagttttggtgcctttaccagcacttccacgatagtagaccaatgatttctttagaccaatgcattcatggggttctttaacacagtatataggcttgtcaattcctgtggctttccaaaatccagaacctgtcactctattaggccttatgctgttcctgtattttctccctcttatgcaaaagaagtaccattccttttcccccactgcactcacttcttcatacattaattagttatcagcatacataaaattacttgagattagaaatcatgaaataatccataccataaatgtataaaatcaaaatggggtggctagctagttgcatacctaactagctagcctagaattgaaaaccagctaaatgtatatatatcatgcgtgtatacaccaactctgtcttcattttcaatttatattttatccaataacatattattgaagcccgagtttctacatcttcacatgaaaacttcccaaaatgttaagtatcaattgagccatttaattagtcttttgttatccatataattaataattaagatgtgctagttaagtttatctatacatacacttctccaacacaatatatatatatatatatatatatagctttctttagttaagcttaattaattatcctagcttgtttcattcaatttatatatatatatatatatatatatatatatatatcaaacactctagtccttaattattgaattatatatatcaagaatcataaccaaactcatgaaatttatctactgcagcagaaacaaaaaataggtttcactttcagtgactgataccatatattaaagaggaagctaatcttacttggaagatcccatggatcatatttgtagatgtcaatctgtttgatgagttcaattctcagaggcttcttctccacctttcgtctcagataaaaccccacaagctcttcatctgttggatggaatctaaacccaggaagcacaacttcttttttcttgtcatcatcatcatcagagttatgtaacttggacacatccattattagtctgtgtgcaacacttgaaaacttgggaaccttcttataacgtgtaaattattattttcctcctttccatgtatttatattaatttttgtgacctcattgtgtaaattgaactttggctgctggagtcaagtcaaatatttccattatgaagtgcatatatatatatatatatgtgtgtgtgtgtgtgtgtgtgtgtgtgtggtgtgtgtcttaaaaataaaattaaagcttacaagtttttgaccagatgatacatatcaatttatttaggggcctccaaaggacaaatgttaattaatcgaggaaggtgaaatgccaatgacaagaattttgaatcgatgttagctttgagggcaacaacggagtaaagtctacaagagtgggcacaactttgactattacatacatatatggattggaatggaacagatatttgcaattaagaagggaaaaagtcaaaagagatttcaaagacataatttttttagagaattttcgaaagctaactttaacaaaaaagattaagatccaccaaaatcactatctagttctaaatattttcaaaggtaataacccttttcaaacagagttaaatatactttttgttatcataatttaacatttttttttatttttataacttttttttctttttagtccttgtaaaatgtgtttattttgtttttcatctttaaaaatattttagatagtgttaagaacaatgaaaaaaatattatctaaaatgctttaagtacaaaaataaatattttgcaaagattaaaataaataaaaattgtggggaagaaaatgaaaaaaaaaaatgcaaatgtatttaaaccttccaaatattgatttctacctttctaaaagacattttgtcataaaattaaatctacagcccaacaatttgcaaatgatgatggtattgtttgcatatttttcctgaaccaattaattctaatttgaagtattcttctttttatacatacgataacaagaaattagaaatacaagcatgaattttcttttacgttccttctcattttatatgtttgctttgatcctcaataattcatacgtgacaatatgaggtcactcaaaacttttatccggagtgactcctgggtgatgtcacttttaagtttaggtctttatacatatgtagttgatctaaagaaccgaagacagttgtttccgaaaagtaaaaaacttacaatatatatatatatatatatatatatatatatatatatatatatccatctttctaattcagtgtagaagactggtaatgaagaaaaaaattattttccagataaatacaaacgattgttcaagttctggaataaattaattaagcacaagaatagtaaatataattataatcgaaaactactaagtaacccgtgcatttgcgtgcattgctgttggttcgtacattttttatttattttatattctctgctagctattcccctagaaggaattttggaattttggcttaactctaactcatgactttatcataaagcaaacaggttttgtctatttttagattctcataaatgataaggactagtgacaacaataagaagcaaaaacccaaatcacgagccttctgattaacaatctatcttcaagtttctgcaattcattgagacgagacttaagaaccactcttatctaattcttcaacatttgaattaattaactgagaattcagtacacatattagatctgtttgttctcctttttatcttcttcggtacaatacaatctaaaagtttttaacctatttgctaaactcctttgtcttgaaaattctttggcccaggatgaagtgaaaaaaatggacccctaacacacaaattttttgaatacaaataatattaaaattaagggatgaaaaaaatgggcccctaacacacaaattttttgaaatacaaataatattaaaactaaaggatgaaaaaattggcctctaacacacaaaatggacctctaatgtaagttttgtttttatttttttaattttttttacttaagttatcagtgtaaaaaattttggaccctgggcgggcgccctgctcgtcctgccccagggccaggcctgtttaccactagggttcaagttagtggcttatgctcttactttttatgttatgcatgttaggaaggaaattgtggtgttacatagtaatcaagaaatttatacggcaagaattgttgtctattttatgtaataatgtatcatataatacgcaggcaaatatctttgtgctacttgaagcagagtttaagtcattagtacaaatcaaagtcgtgatgctttctttgatataaactcatcagattgagtgttgaatttctcaatcaattccaccacattgatttttccaagagctggttgtgtcactatttttaccggagaaacattttcattttcaagtagtgcaaatttgttgcccatagctttgtgttccttcttgaacttccaaaagagtttactcctggctttggattccagtctttcttggttcatcatcatgaatgaatgctagaagagcagaaagcgtgcttaatctgagaacaaagaaataaatgttacactaacatcacttaagtttttagtgttgtacttataaatagagccaaagtgtactagaataatgattgcatcctaatatttaaaacaaattgataacattcttaattggtccaactgccgaaagtttggtcctcctggtccttactttccaactataggataaattggtctggtttgaacaggaataaaggattgtctaagtctggaggatgacctctctctgtggtcgaatccgatctctctgctaagctttatcacttttaaatctgctaaactatattatatcaacgatcttaatttagttagtaatcaacactatataagctattttctgttgtcttgtttttcataattagacaatgacttgacatcataaataaagaaagaaaaactagagccaagatttgtaagaatggtagaactgatctttgacattttgtgatgcagatcaaatcataagcaaggggcacatgacatcaattaaaaaaattcttacacccattaatttaagcagcgaggaaacaagctcataccaactttcatgataaagctacaattttcaaaagctttttatcataatagagacagagagtttcaagtaatgtaacagacttataatctataaggtgtaacttgaatcttgattattaaagttgtgattaaattcagctgtgaaacacagagctacatattcccataccgttgaaacttctgcttcttatctgatagaattgcatgtacaatcatactcaaagaatgggaaccgcactgcaactaacaaaataaaatatttcatcacttactctttctgttcaactagacaagtccaaagcaggtataaaagtcaaaataaaccaagttttcatttttttgctaagcaaataaatcaagttttcctaccattttattagactcaatgtcagattaagagcagtggggcatttatcattgttcgatgaattccataataaggaattagtaaatggctgagtttttcctcattgcagagacaatggatttgagatttctgccaaatttctacacaccatttgccccggtcatttttcattcactatattgtttcaatgccaggatgcaattgacaatcctagatgattttcctccctaaaatatgaccaataactcagtagaaaccaaaacaacaacacattattaaactatcaagagtctgcaattaagtgctgactatctggtgttattaacaattgaattcaccatgatatgaattggttacttaaatgaaaacagttaacaagtatctaatgctttacttataatatttactttcaaaatactgatatgcctttaatggtgccgcatcagggatcaatgcggaatcaacaggactctccgcaaccttaaaagaatacattgtaacatacaatgacggaataaccaaaacctgagccagtaaaattgcaaattaaactaaattatgatctaactcaccttggatacagttcccgattgaacttaattaataacaatacagagaataatcccacttctcaaacgaagcctaaactcttcctctgagccctgagggctctgctggcaaatctttagctgcaacaactccaaccatttttctcaaccaccccgctgcttcatatcctgctgcatggtaaagatttttctatttcaggattaaaaaaaaactaaaaaaactacgtaccccattgtccggaggcttcacgctatgcgtaggtaaggggagggatattgtaagcagccttatccttgcatatgcaaataggttatttccggattcaaactcatgatcaataagtcaccaataggctatttcaggataacggataaaaatccagataccttttctttgagaacaaattgaaactaatcaaatttcagtcaaagcaaccaccatagacacacgaaaaaaatgataaacaaacacttcacgttaaaagatgaatttttacacattattattatctacaattccaaaactgaattttgatggaatcccagaaaaataatgggaaagtaccaactttttctgctttcctagattccaaatcaagatctttgaggcgaggactgtgtcactgtgctgtcgaaacacatcctccaccaaatttgttcaaagtgctaaaggtgaaagaaagatatatttttaaaatagaaaaccaagagagcaaaatttgtaataccaattagatcactcctattatttgctccaagtttaacaaacaccataattttctgaatgccacgaatgttaagatattatatttctgtgatggtcgtccgtacaaaatattagaatgttcaattatttctgaatacactatccaagcaaagtattttaggctgatttttaaaaataatacaaattaattatttaattaggaaaaggggataatttttccaataattagcaaaatggtgcagccaaacacgcccatttggggcgtgtttgccctggtggcgccacgtggtagggaaaaatgggggtgcagggttttcgcggtgttttcgtaaaattacggaaggcgataacttttgactgggacgtccgattgacgcgaaaccggtggccacacgctcgaaattgagaggagaagccgctagcccaaaattttttcccaaacgaggcctctaagtgcctcaaaaatgcgatttaagcttcggagccccaaaattttttttgttttctgatattttatctactcaattagtgaattgcaagctattctttatttatctatatattaaaaatattaatcctaaaatctaaattaatttttttttgacagcaaaaaatcattaaattaaaatacagtatattcaaaaaattaataaaaataagaaatcgttttacaaccaaggaaatgttttaaaaagtccacagccaaagggcaaaagaaaaagtaaaagtaaaaatatgaaaggaattgttgttacataccctgtggtggcactcatatgctctcccggcaagttacataattcagtcaaagctgacctctaatctaagcctgcaacctttcttcatgttgaagcatgtgtttccagtaactatttctatgagggttctaaatgctcaaatattctttcattcttcaatggcattggatagagcaggtggaaaatgtttcatctatgatgttttcctcagttttagacacgatttttgaaattttgaatgaagaaattaaggttactaatttgaaaattcttaaatgagaaaaaataaggaagaccaaataaaattcttttatgacaaatggattggtttatttaaattattattatttaacaaaactctaatgatatttttttcttaaattgtttcttatatgattttgttaacactataggaaaataataaaaattatgtacttatatatcaatggtaaacaaatattaccaattcaatatgtcaatgatagaataaaaatactaatttaatattcgtaaaatttagttttcaaaagttctaagttactcccttattagtcctaaattactaacttttttgtcatttcattaaatttaggattaaattaacacaaaaaatacatttagaaattaaaaagggagtgactttaaactttcgtggactaaattgtagaaagacatatatctagtaacaagttaaaccagaatacttgaactacaacaaattaattaatgagcatggaattgaaggaggatattttttactgtaatcttcttatggatcagggaatagtggtcaaagttgtttttttataatttaatgcataaaatatttaaataggtctttgtcatttaatgttatgtgaaaccttatttttattgggtgtcataacttatggtaactttcacgattttaataaatattttgttatttaaaaaaagataaataatttctcacttttataagtgaaattatgagtttgtgtaatcacatcataaatatttttttcatataacaaatttataataaataatttttcctaaaaattagagatagttatgaattggatatgatgaaatttatgacttaaacaaatcaaaatagtttaaaatttttagtcttttttttttccgaccatttagattggataatgaagggttgaggttgggaaagatgagaaagaggcatagagggtgttagttgatggtttttttttttttttctatatatcttttgcacccttaattttaatactttcacctcttttcttttgttgtggtttaaatttttgaaataaaataaagataatagtgatttttagttgtcactatattaaattattttaaaattttaaagttaacataatattaatgtttctaacgaaaatcaaaagaaatgatcaaaatgagatactttaaaaatttaaagtatcaaaataaaattttcaaaacttaatatattagaataaaacaactacaaaacataataaatcaaaagtgatactaagtcaataatatataattcactacatttaaatttaaatgtggagcaacaatttattttaatagaaaacttgtgttagagggggaccaacaagatttcgaggaccccttttctcctctcttctcccttggaacatttaatgtatatatatatatatataaaagataattagtataaaatttgtaaaattagttgtgtttgttgttttattgtaataattaatataaaattgtgtaaagctaattgtatatttgttgttgttaggataataattaatgttatcattatttaataattagttttaattttatgactaaaaatagtaattttttaaaaatcattatttattaaaagttagacgtttataaaagaagaagaaaaaaattcaacttcctttataaggtttctgacttagtatatatgttagaagaaaaaaaaatcaatctgtcagcgacatgcatgcatcgaattaatatctgacttagtatgttagaagatatcatgaatatttatcctattaataattctaatttaatttccctcgctgggagccacttcaaaattcaaattcgactcttcagggacgaaggcacctcactgcgcacacacacctctctctctctctctctctctctctctctctctctctctctctctctctcgattctcaattgaattccaagttagggtttctgaattccctgatatgctgaggagcgtgttagggttcatgatccgtttcttcttccgatccttcaccaaagcgatgggctgcttcttcgcgtgcttcaggatcagagacaatcgccgcacaaacacatcacaattgattacctcctccactcgatccaccgtaacatttcgcatttgtctttgctgttttcacgaattactttatttatatttttaatagtaattagaattttcgctgtgtggaaacccagggtgttgtggtatctcgaaatcgctcgtcttctttattatctgaaggtacttttctttgtttcttcgttttctttcttttcgcttttacattttctttttttatttttcccgctaattttgtgatataacctttttagaagagagagatgattctgcgaggattgatggtgttgggtttgagggagatttccaggggcttaaggatgaggtattttcatagtgctattaatattggtattgcactattactgcagctgaaatgatttttttaatggtttttctcaggtgtttggtctttttaatttttgtattttttgtttgaactagttagggcattgagtaaaataaggttcaatttttatcttgtgaattggcgttaacctgggcaaaatggaatctgcaaactgacatagtataggtttcttagttgttcttggacagttttgaattgtaaattttacgaaccttcatgaatgtagtataaagaaaaaatatggaaagcaatagagtgatttcataaaccttttctgtaaaacatactggaaacaattgaataatgaccacaattaggaccattagttagcttttttcaattttggcttgtgaaaagtcagtcatctatcactctttctatgatctgctgtgtcctcatgttatacctgttttgtatccaatgcctagaggattatacttgcaccatggtatatatcaaatttcaaatactttcaagttactcatagaattttttttttttttttttttttttcttcttgcattttttatggattgtattcattttgttattgtcaattgaattttttatataaactctttctacaggctaagtttcttaaagcttgtgggaccttagcaggaacacctgttgaaattcgtaaagcatctgagaatttgaaatcacctgctcctgataaagattcagacccttcaagatttcattcttggcttcctaacacgtctgtggagaaactgcagctggatgtccaaccatttgatccaccaacacccataaatctttgccaaaagttgggaaatagcatggattcatttgagcacacgccaagcaggttattcatgactttttttttttttttttatgttaatgctgatattgaatgataatgaatttgaacaagtgatattttagtcaatttgcatggtaggtgaatcttcgatttttactcaatttttatagtaagctttagatacattctcaatagttagagctccttggtatagcaactgcattttaactataatatagaatcagacaattcgttctgctttaaaaaaagtgcccttcaaatggttcctgcatcctttctttcatattttggattttagataattacttaattgtatgattgttggttggaacttagaattgtccattgataattatattggagggaggactagaacctgatcagattttaatttcatttcttttgcagctgtatctccaaagcacaagatactgaagatgactctgttgactatatggaaaaaaattggtcagggaaccttcatgcggcagataggtctgaaaggaatgcagctttggtttcacctttgctagccacatatactcagagaaagaacaagtctgttcgttttgaaagtgaaactgacttggcaacctatggaagctcatcagatgattggcatatgaaggaaaacaagtcaccaaatagccaaagtgcgcataaaccatctccttatcctaccccattgaagttatttgacgagatgcaaacaccaggaactctgtaccctgcatcattagaagagttacgtaaggctaaggctcaagttcggtcccagtttgtctatccaactaacgaaccaggtgataatgtcttctggtgcaaaatactcaaggagagagattttaaccttgaagaagattcaagtgagctgagtgatttggttgagaaagctcaaaatgaaactcctaccccagaaaaagggtccaagaaattttcaaatgaaaatgacgatgaggtcaattcaaatttgtctactagaataagtcctgtgtcaaccatcgaggagcattcgcctatgtcattcaagtggtggtatggcaatggcatcccgaattcaacaactaagtacaaggaggtatggcttgtaatcattatcattatttgttataaggtttctaaatctatctacagcttctgattagtgcttattgtccctaggaccagaaagtaaaatggcatgcaaccccatttgaagagaggctggataaggcactgtgtgaggagaattttatatctcaaaggtatctctagttaataacaattgattgtcatcggtttacctgataagaaggattaaaggagcaaaaagaagaaaaaatctttgtaaaatttctgttaaccatgacaaaaatgacaatttcagttttttttttttttggtgcaaatgacaatttcagttggtgcatgttatgctttccatatatataatgtgctggatgttagtaatggttgatttttgttgaccatagaaatttcagtcgagtttaacacatttgaaggataaaaagtcattccaaatggttgaggaatacccatttgttcggcatgtctagttgcatctaatccactgtttttataaattatttgttttattttgttggggaatttgctgtttttattttgaaatagctgtattgtgttgttttatttctaacttgttgattcttaatatatgaatttataaatgtccttataatttgatatttgatttacaggaagcttgtttgtgggaaaccagtggaatttgatgagattgaagaaagtgatactacattatctcagctatagtcggagactcatttgctgtctgtggtgtcattttgatatctgtatatgttcatcccatcccgttgtagtcacttatatgagaagtaattcaatattctggaaactaagtacgaataaacatcattcagcatgctggttgctttgtatcagcagttgattattcaaattttgcagtaccatagaactatatatagtttcatccctgcgtaagcagtgaggaaaattttcattcacaggaggaaagtgatagaactgaatggttttggataagaacagtaggaagcttagatctgtccagtcagatttctttcatgatttcttctcatgagtagctgctgatcattctgtgaataaattgatatttgttagtcgtggatctaaaaaggtgacattatttttttggtgaaaaagtgtctatttttttttttttaaattatgttgaaagacttaaaataacaattggccagtcttttgagggttcattctataatgtttcccattttaataaagagaagatcattattctttcctagagcatttacaattacaagatttctttcacaaatagtggtgctgcaagagatctttacctaatttcagtttgagttgcatttttttttaaattttgtaaaaatataatcattttttactttatatgttgatttatatatatatatatatatatatatgttaaaaattgattcaagagacccatctgattttttttaatcaaaggcttggttgaagttctttatattatattgtattatatatatatatatatatatatatatatatatataatgtttccagtgaatgagttaattcagcatactaaacaatagtgactcaaataatatgaattatcacttgacatgtaaatttatataactaaaagatacagtgcttgagttggagaggataccttcaattcaattaatgtcctaaaataagatccaagaacaagaattaaaagctgaaatgaagacattgttattatcaaactgaatttctcttcattccctattttgtcatctgggcacgttctaccttttcaagggtttaagtagtagcgcgtttgtaaacaaaatgataaagtgtttcgaatgcattttgatcaatttcctgccaatttagtcagtaatagtcgatcactaccacttttatttaagaccatgtgtgagttagaaagactaacacgcaggaaaacgtattttgaatgcatgcatgccctatcaattaaacattgatccccctctttctcacgtggtgtccccaaatctcacccatcaacctcagttttgtttgtgttgatgtagactttgtttgactatttcacatgtagaggcactataagaagtgtaactaagcaacaataagtggctcttccaattcactcttgttgaaggatttttcaagagaaacaaattaaccatggtagtgaaggtgtacggacccagctgtgcttccacaaacgggtgctagtttgtctggaagagaaggaaatcgaatttgaggttatccatgttgatatctttaaggggaaacagaagaatcctgagttcctcaaattacaggttcagctcttccatctatctatattccttccgttcttgttgaatatgattagagtcttcaagattattatttgattaattctgtattttctgattataatgttctttattcgtaatatctgcagccctttggatgcgttcctgtcattaaagatggagattacaccttatatggttacactttgaactcattttcttgcttaatgattaatattgtttctccggttcaactaattttggttctactcttacatggtacctgctaatttgagtgctttcatgtgtttctgcagaatctcgtgctataatgagttttattcagaaaaatacaggtctcaaggggtagagttgatggggaggacagtagaagagaggttgtggaacagtggttagaagttgaagcacacaactttcacccaccagcctacaacttggctcttcatgtattgtttgctacaatgcttggagtgacttaagatcccaaggtgattaaggagagtgaagcaaagctgggtcaggtgttgaacatttatgatgagaggctgtcaaatactaagtatttggctggagatttcttcagccttgctgacattagccaccttccttttgttgagtatgttgtgaacaaaagggagaaagggtatttgataaaggagagaagcatgtgagtgcatggtgggatgacattagcaatagaccatcatgaaagaaggttctccagctctacaaggctccaatctaattttgaatggacttcatggaaactgaattattagtatctgttgttatatggaatggcaacagtatcatcattgaatatatatgttagagaagaataaatgaacttttaccaaattccaaagaaagttaggaattgaggaagaaagtgggtaatgttcaacctcatggaatggaatgtgttgatttgtacttccttgatctcctttttattttcagttgtgtacttgtgtggaatttggatattcctcatggtcatgttcttagcattcgatctgtttaccctctatttttcttactcaataagaatatatatgacgaatgtttttccaaatggctcattcacatgagacattgatcactttgattctctgccgagtaaaaaaaaagtttaatgtagtattatatacacaagtcatgagactctcccaattaattaacaaatgtagtattagtttttttagttggagtgtcgtcttatactgtagttataacaatggctttccattagatttgaactatgtacaagaggttaacatgttatgagtcttcacctaaaaaaagaagaggctgtttattttaaacatgttatctggtttaataacaaaatataaatatttaaatataaatacttaagataataattttaaaaaatatagcaaataataataataataataataataataataataataataataataataataataaaccactgaaaagctctataatagcaattttgatagctattacttttaaaataagatttaattatatttttgatttgttagatattaggatatattgtgcaagtttaataatatctcaggttttaattatattaatcgagtctctaaattatcttcaattttacaatcaaattcctccatcaacgttacatgtttaacagactttgctaacatgacatggatatgctaagttagcatgatgtcacattgatagatgttgatacacatattgacatgttacaaacatactaatgtagtgcttgatggttgtcacaatttgatggcgtgatagttcgaatctcatctccattactaaatttgtttctcatcacttttgcatgtaacataagcattacgtcatcatttaatgtcaaatcaatatatatgtttaggcaatatagcaaaaatattatatttagcagattaatgatagagacttgattgcagaattaaaaatagttgaggacttaattagggcaattagaacataaaaaaattaaaataatataattgtgaaccttgaaaaataagaaatgcaactaggcttgataataaccatatattggttaggttctttacataatttttccttttcgtacatacggagtttacataattcaaattcgtgttccaatgtactgtttttcaaaaggatcaacttaactccttagcgtgaacctgtggaaaccatgagttacttcaattccattcttatttaagaccacatatgtaagttattagcaaagactaacacacacacacacacatataccaaacaaccaaatattttgaaaacataagcgcacctgaattattgacccaagggaggaaataagatcacgacgtatgatcttataatctaatagcccaaaaaagataaggacccaagagtctctccagaagcaacaaccagtgagtttctttctccacttaataactattaactaatgaaaagtgattctcctatgctgcatttctgatatcatttatttatacaaatatgttattgataaatatttctaagatattagttaaagttaaagaaaaaatatttattatttaaattgtaaaaaattgtaaaaaaatttataaataacataattttttttaataaaaatatttttattttaagtttttcaaccaatatttttaaaatattgattaccatttaccttttattaatctattaactaaagttaaagttaaagttgtttacgcataacattaattaattgattaaaattatacaataaatattaaatattaatctcttgtttaacgtggtgtccccagattagatcccacccatcaacttgatatttgttaatttgcttgctgctttcactgaccacttgacatgtagagctataagttgttttgggtcactaactaaacaataatatatatttgctgatcaaacctgagtaatataactatataagtggctcttccatttcactcttgttttgaaccatttttcaagagaatcaaaccatggtagtgaaagtatacggtccccactgtgcttccacaaagcgggtgctggtttgtctggttgagaaggaagtcgaatttgaggttgtccctgttgatgtcgataagggggagcagaaggatcctgactacctcaaactacaggttcaactcttctattttcctttttttttttgttgaatatgatttgtcttcaattctttatcttctcattcatgttctttattcataatatctgcagccatttggagttgttcctgtcatcaaagatggagattataccttatatggttacactttgtgctcctttgttctgcttttctacttatatatagtttgttggttaaactattcacttgctttttatatctctctaagttttagagtctttgtaagaaaactatacgttttagcgttagaaattcttttatggtgttagcatgattttaaattacgattttaaactatacgtttgacattgcggtcgcaattgtggttgcaaaacactatttaaaatcatgggtgttagcaatagaatcaaaacttaacttgtatgtgtagggactaaaactcaacagttttctgaactaaaattaaaaaagatcaaatgattaataggttaaccaattttgttgatctatgattattgttccttcagtttttgttactggtaccctttaatttgagtgttttcatgtttttctacagaatctcgtgctataatgaggtattatgcagaaaaatacagatcccaaggggttgagttgctgggaaaaacaatagaagagaggggtcttgtggagcaatggctagaagttgaagcacacaactttcacccacaagcccacaacttgtgtcttcatggtttgtttggttcaatatttggtgtgactccagatcccaaggtgattgaggaaagtgaagcaaagctggtgcaagtgttgaacatctatgaggagaggctctcaaagaccaagtatttggctggggatttcttcagcattgctgatattagccaccttccatttcttgattatgttgtgaacaatatggacaaaaagtatttattaatggagaggaagcatgtgggtgcctggtgggatgacattagcagtagaccatcatggaacaaggttctccagctctacaaagttccaatctagttgctgaatgagtttcagggaaaacagctattagtgtatcatctttgaatatgttagtccaaatgtacttttagcatattccaatgaaagtgagggattgaggaagaaagtgggtagtgttaaacttaatagaatgtgttgaatttgtgctttctttcattttcagttgtttgcttgtgtttaatttggatattccttgtggtcatgctcttaactttcctgttgtttaccttctatttttcttttgctattgaataaaagttatatgttttttttttttttacttcttatgtttttttagtaaaaaattagaacccacaatttctttcctttcttttctcttcactacctgttctggggtaaatattaattacccttaatcgcttgtaaagccaacgatcctctacgagacaaaaaacatatgacacgttccgggctaaatattaactgagtctgtcaaggacaccttaaaccggtcaaataacagttaaaaccggtccaaaaggacaaatccataaatgacttagcagactatggtattatgttaataaatctcttctcaccattgagtatggctgcttgaagatgcatgatctaatacaagatatgggtagagagattgttaggaaggaggcaccaaaaaatcctggccaacgtagcggactatggcattatgttgatgttattgaaatactaactgatgatttggtaagaatcatgtatcttttgttttataaattatacattatagtctattgtaataatgacaacatgcatttgacgttacttgtttgtactttttttaaaggaagtgacaagattaaggggataatgcttgatcctccccagcgagcagaagtagattggagtggttttgcttttgagaaaatgaaatggctcagaattctcattgttcgaaacacatctttttcatctgagcctaaacatctgccaaatcatttgagggtgcttgactgggaagaatatccttcaaagtctttcccatcaaaatttcatccgaaggaaatcattgtctttaatttgcctagaagccatctaacgttggaagagccatttaaggtacaattgtgtagaatgttttcttgttctttctacttccttttattttttcatttaacaaaagcttccattgttactcacatttaaaaataatagtataacccaaacatgttgctaatcattgtactaaccttttctttctggcagagattttcatggctgactcagatgaatttttcacataaccaatcaatcaccgaaatgcatgatgtttctgaagttcaaaatctaagggaactgagactagataattgtagaaacctaattgctgttcataaaaccgttggatttctcaaacgactttctcatttaagcgtttcaggattcgtggtcttccaggatgtaagtggaagggcgagagcgagacagtattctcttcctgaacttgttgatttgcaccttattatcaatggcactcgatgtgttcctcaccacaaaggctattacaacttcagagttgcagcagatcacgtcttaatttgtgatctacgagttttgttcagtgacgaggagtggcttagccttgatgcagtgtttctcgagcacgagtggattgtagtgcaagtttcatacgaagccacgtccaccttgacgctaagttgttggggagtctttgtgtatgaagaattcgaaggagcgaacaacatggaagatgtccaaatcacgtgtccagaccccaagtattcaaacatgttgttgtcaccggcattagttcctatgaaagatcctaagcaggaattaatggaaaaagataatagtggaattacctctacacgaaatgattaagcggatgttcattgaatcagtggactagtatgaaaaaagaaaggatttgcagggtaaaggtttagaggaattgtattccctaattggatttataaaggagatatctacgcaggctaaggacaaattggaatccgaacaggataataaaaaaacactccctcctgacatctttcctacatgtactcgaaacaacgcctttcctagatgcaatcagtacaatgaaagttgtagaagcttcaacctcaggccatcagggaagtgatcgatgaggaacaaggctatgatcctcactctgagcatcaagaaatattgaggggaataatatatgatggaatgacagatggacatagctttccttttctggatattgttaaaaccagaagtgcagcttaaaacagcagtaaatgggttaaattgtcacccaattggaatgtggtactacccacagttgcaatgaggatgtacatgattggaattatcaacggactccttgaggcaaagctgagctttcgtgatttagacgaatgggcaacatcaaattcaaatgccgttttaagttgagcctgataaggatctcgcactgaaaggagtgaaggaagaacccggggacgacgaggtagaagaagcttcatcctctggccattagtgaagtgatgagaaacaaggctacaatcctcagctgcaacaattaacgaggcaaatatactatgatgcaatgatggatggacttgttgaagcacagaatataacatgttatgtaggacaggaatggaaagcctccatgagatcattcgccggtcgatacgactaacggatgaagtgaaggcagctgtccctgtgggtgttgtaggagaagctgtggctctacaaaattattagtttccttaattgataaatgtaaaaactaattaaaaaacatttaaaaaatcaaatattatttgataaattttaagttaatattatttattaataccaataatttaaaaatttaaaaatagaatttgaaagtcgtaaaagatcataaaactttggagactttggagtaataaaaaaatttacaacttcatataaaaagaaaaaaaaaaaactaaagttgttcagctttttttacttcaataaaaaaagttgtcaattttttatgagtattaattcaaaatttgtttgataaatttgaaaaggaattatccttttggtcattcggccaaccaattgagagaagaaaaaagtttagaatctaataattaaaaaaaatgataaaagttaaaagattcgcagaactgacaagcgcataagtaatttatatatataacaatccagacttctcacagaaggaaagagaggaacaaaaagctttcaaaaattagtgataagataagaagaaaaaaatcagataaaaggtatataaaaactgagaatgaaagcattaacatttagtggagattgggagaaaatttgaacgttaaaagataaaattgtgaacattttaataatctctgaaaataattaattaaagagaaaaccattttttgtatgaggcacgtttcaatgggcgcgcaagagagataaatcgaataatttggactccatctggcccacttaaagcaatttcatgcagacaagcacacactttggttatacttgtttgtttgtatttatatatacacttaaaggaaagctaaaccatatcgttatgttgtaacctaaaaaaccatgagccttatgaagtgttacaaaacacaacaatttattaatagcagcttttggtactaaaagccttgctcagtagcataccattggacttcttcctcagtgtttctttttgaaacttgaggggattttgacaactagtcgcggttaaaaattttcaaataggtgttagtctttaatttatgatttttatattttggtaatatactactatcaatcaatgttctttagctttagacggttttatattgctttttttattagtccagtgactttttcctgccagaagtaaaagaagtaatatatgccacacttaattaatagccaacactatggagtgaaaatttattaatgtgatatatagcatcacacaggtccccaattctgccatcatgaaagacctttagtggatatatatagaaccacatactcaattgaaaactaagtaacaagcatgcgggtggtcaccaacaactaccatacttaatttgccagttgacatttaatgttattcttatcagaaatacagtaatatttacacacaacaaacgttttgatattgttcgggaagtacaagatactacaattggaaatatagtatttttcagtcaagtaaacgtgatttgaattaatgatacaaattgtgttatgagatcaggcttaaaattgacattaatatcaaacatggcacattcaattcgcatgtctctctaggccactgccagtaaattcatgcgacccttacagcctgtgcattaataagccaatcaagtagtactgccatggtgaattaacaagcctagctagctacacagttttaatattcctgaaaaatggatggtaaggttggagaaggaaaattcattgtgagtgtgaccaaggaggaggtagtggtaccagagctttcaatgaaagagcaatggctgccactatcaaaccttgatctactcattcccccagtagacgtgagtgtattcttctgctacaaaaaacctttgcctgaaaaatattattgctttggaaccatggtgaggtcactgaaaaatgcactggctcgggctctagtatactattacccttttgctggtgaaatggtggccaacaccatgggtgagcctgagctgttttgcagtaaccgtggggtagatttttttgaagctgtagctgatgttgagctacagtgcctcaacttgtacaatcctgatgacactgttgaagggaagcttgtaccaaggaagaaacatggcgtgcttgctgttcaggtgatacactataaaacaacttgataaacaaacctatatcttgaaaatgtttaccagcatatgttagctagtatattagaacataggttataaaactaaaagaataaagtttttttattgagatgtcaaaaattatgttagtgatcataattaattttttctatattttcttataattttacattaaaatcttttttctttgaattttttagcaagtattataagagtactggttagtcaaacttatttttatacttctttgattttttttataagacctaaatttaaaactgtgtttgttcatcgttaaaagaagaaaaagaatatattaaaaataattaaaaatgaaatataaatgataatgataattttataaaacattaaaaatttaaaacaaaattattgatattaattaaattaattatttttttaatttaatgaattagataattgagttttatatataggattaaagaaatgaaatattaaaacatctttagtggtagatttcaaattgagattttagatatttttttttgtagatcctataatgttatttaggatgtaagatttctctcatcttttatattggtaaatctcattttgaaatcttaggaaagaaagagataaaaaattattctttgaatattgtgcattttcatgattcttctataacaactcattcttcataatgaaaatttgtttatcttttttattagaagatctaataaagacgaaattttaagctgaagatgtttgctcatacactaaatatgctctaaataaaaaataataatcttggttcttaaacgcgcggaaaacatattattaattatttatcttataagacatgtgagttttgcaggcaactcagcttaattgcccagtttagtagttgcatgtactttcgaccatcgcatagctgatgcctactctgcgaacatgttcctcgtatcatgggccgaaacaacccggcccaacaagcccataatagcagcccagccatgtttccgacgttcccttcttaccccacgacgcccaccttccatccacccttcactccaccacatatacgttcccgtctcggcgctacctccaccgtcagatcctaataagaaactcgtgttcaaatctgagccactcatcagccgcatatactacgtcacaagcgaatacctgaaccgcatgcaagcactagctagctcaaacggtaccgtgaagcgcacaaagctccagtctttctctgcattcttgtggaagatggttgctgaagcaactgctagtgttgatggtaagaaaaacgttgttgccaagatgggtattgtggttgatggaaggaagatgttatgcaacgatgaaaagaacatgagttcgtattttggcaatgttctttcgattccttatggtgggaatgcggttgatgagcttgtggaaaagccattgagttgggtggcggagaaagttcatgagtttttgaagatgggtgtgacagaagaccattttttagggcttgttgattgggttgaagtacaccgacctgtgcctggtttgtcaaggatttattgtgggcatggaaaagaaaaaggaccaagttttgttgtttcttcagggcaaaggtttccggagtcaaaggttgactttgggtgggggaagcccgtgtttgcatcgtaccattttccttggggtggagattctggctatgtcatgccaatgccttgtgctaatgggaatggtgattggttggtttacatgcaccttctcaaggctcatttgaatttcatggaggttagggctcctcaaattcttaggcctttctcttgggatcacctccttaattaatcgtcattgcctttgcttgttcttcatcaatcattcaacttgttgatttgtaacaagggaaaataatttctagtgtgaattttatccatacaaatagtatcaagtggtgttggtgtgacgctagtatttatttttacttgtaatttttgccattgcagtatatatacatattaaaatacgataatgatatagtttgtcaatatattcatattaaaaaaatataagtgtgtaaattagtaaatcccttaattatatgggtaaatataattaattttacttaaaaaatagttgagaattaataaatgaatatataaaattaccgtagacaaaacttttaagctaattaactataatagatgcatgtgcaactgcagttacgcaacatcgtttcatttcgttacccaaaagtgtatactcgatccgaagctctgaaacttgaaagctaccaattacaatcatctctctgcgggtagaataaggggtcgttgagtgggttattcggatgacaatcgctgttagcaactcagcccacatttcacgacccaagaggactaggcatattgcttcctacaccagacgaattttcaatatatcccgcactaaacattacaattccgatattaccctttaataaataaaagcttgtaattcataagagcattatgaattcgtaatctataagattcatacggattggacaatccaaatcaactgaactaacaggtcatttatgttaaaaaataattaatatcattatatataacattaaaatttctaatgtatatttaatacatatataagtttacataataaattttataataattaatttttatctaataatatatatttttacatatataaattttataaccattctacgatttaaaaaagcaaaatactttcacccttgtccgatcctgatcctttgccgaaattcatgttgtctacttaggggtttctcagcctatagggtattattgtttgaacacctcgaaactatcacatctttctgttctatttctttctttctttcttcggatgtaaaatagctagcgttgggttctctatgaaacatgtaaaaagaaaattctgactaagttccttattgtttattgcttgacaatattaacagctcacaccattaacttggttctgattggttatcgtggcctttccttgatcacccagctagctagttgtccacatacattcaccataaaaatggagagaaaaagacaaagtcctttcgggattctaaaagttcatgaaagcatatccctttgaagctttgacatggaggaagaggaacaacttaatttgttgtcaatgtgacgccaacgttcaaaattttaaactacgctaaattccatccctcataaatgcttagaaagagttatttaacactcaaaaaaattaaggaaacgtatgaaaccatctccaagaatctagacgctcctgaggacaataagttaaaaacttgaaagagcccacttgcgatttgatttcttatctactactgcaattagctatatatagctggcagcatggttgagttatatatgctgaaacttatattctgttgattatttattattatagcatgcagttgcattgctttgattgttatataaagggtatttcaagtcttggcatatttgactttgactacaatccttacgtgaattaattatttatctttaacaaggaacatttcaagatgtattataaaatgactaattgggtgatatttgacacacacaaatagtgaagtggaacttttttaatagatgtaattacagaataattaattattcatgtgatagagaaaaagaaatgtttaatgaaatgttttatgcaaaattaatttttattgcgagtttccgcgggttgtattgaaatgtttaattaaggtgcaatatagtcagcatttatgttccgttttacttgaagagttgatgttattaaaagaagaaaccaaccgtgtgaacttccaaacttgtcgtattcgtcgtagaatattttatgcatctgaattggcatcaaggttaattaattgtggtaggaaagaacaacatcacgcatattcgtctttatgctctaattaatattttaaatattctacatttgaaagcctgttaggcagtttaagctttggttcaatttctgccacgatagagaatggaaaacgttcataagttatttggagatcagctccatgaagttgacacgaatgaagtgcacgtggtggtgtgcttcaatttgttttcgcatacccatgaggttgtggctgaggccccaaggaagaaacttgaggctcgaaagtcgaatattcctctggcatctcgtgtttcatgactaaaaagactttacagcttttggttattttagtttatcattattttcagcaattaatgaggcaaatattcagattatgtttagataaacttcttccataagttaaaattaacttttataaaagttcaaatcaataatcctcaaatgtatgtcttacttcggctgtcgttttacggttttagagtttaacttaattgttatgtgatgcatgtgatgaagtgttaagcctgttatattaattggattgggtaaaataagatatattcttaaccatttgacttagatagtgcctttagtcaaaatagttaacggggtggactataaacgtaaaagattgataaaataatctacaagtagcattgcttctatcatgtcaggtttcacttcattccaaaattaatcaattttgtagaaaaaaattaattaaataaaaaataaaaaatcgtaggtcaaaaaacacagagctagtttcaattctcggaggaattgataatgaaccataacattaattacatgcatatgttgctgtctctttaccctcataataatatatatatagatctaacatggtatctagtttgtggatcaaatcttcttagtgttggatgcattgattcccttttgtactttctaactcatacttaagtgagtgtgccaattaattaaaaaataacgagtaaaattacttaatgtattattgtaaaatacaatttttttttcctttcttgaaaaataatatatatatcaaataaaattaagtctgcctactaagacattatttagatgtgtaatgcagactcaacaaaaaaaattacgattcaaaatatattttttttatcggtaaaaatgaaagataaatatgagaatttataataactcatatctatttaatcaattgatgttgatccctttgttttatgactctgaatctggacaaacctaaactatacaagtaatgcttacaaaaacactatcaaaggcatttaagccatccattctacaactacacaagcaaaacaaaagataggaccacatacacacgtaaaatgtaatgtaaggttgccccttttttctggggctacaataaaataaagaaaaccaaacaaaattgtgctcaaaatagagaggctgagagtgaagaggatcgtgcattaaagacaaacaagttgatcacgttaaggattacaaggacactgtccatacattttgacatgtgttaaggctataggattacattcacaatttcctctatatctttgggcaggttctaaaatttgtgacagcctcacaaacgaaaaaaaacctcatcatagttttgctaacacaattatacactcattctcaaaaggttttcatccaatttctttccctctcttttcattggtgtgcactttcacttgtggagctgcaccaacagcagtaaaaattgtgccttgttcttgagatgtctggtgttcttctttgggtgagttgtggacccaaagagaacatcaactccttggtgagtttttcatgcaggagtagtagtggtggtgaaagaacacaaaagaggttttctggaatcagttttgctagtggtgcttctgctttttcaagtgcagtggcagctactgagacttcaagatcctcagaggagagggtctatgaagtggtgctgaagcaagcagctttggtaaaagaacacaaaaggggtacaaacatagctctggatttggacaaagacgttgaggctgatttcaacaatgtggatctgttgaatgcggcttatgatcggtgtggtgaagtttgtgctgagtatgccaagacattttacttaggtacttgctgctcttttgttttgagccttttctcattcatttttttctgattcaaatgaattttagtcctcttattttgttcccccatcatatctaaataatgtctctatgtctccagaaaattattaaatggttcaaagttattatgtgttcatgatctcagttaatctttgcacgatgacacataatgaagttttttaatttatgacaaatatttcataaaattcaatgtgtcatgtaaagattgtgggagacaagagacaatgatggtctcagaccatctagtaatttctcctcttccaccacaacgttaatataattgaaatgtttcttttgttcctaaaccttaagtctaattacaaagttcaattcatatgatatatgccttttgttttgctgggtacagaaaagtacttagcagctagattaaaatatttttactatttttaatggattttaaaattttatttgttaataatatattttgttgttgaattgactcatcttgaaaactgtatactctaggcacacaattgatgactgcagagcgccgaaaagcaatttgggcaatttatggtatgtgtgattagattatattacacactgctacttcagcttctccagtgagagttgttttggaattgacaattattcattgcgcattgcagtgtggtgcagaagaactgatgagctagtggatggcccaaatgcttcacacatcacccctggggccttggacaggtgggagcaacgattgagtgatgtttttgaaggccgaccctatgatatgtatgatgctgccctctcacatactgtctcaaagtaccctgttgatattcaggtactttacatgcccaaatctaagcattacatcattttaggacaaaccttacataaaaagttctttagttgattttgatgttgttctctatcaaaatgggagtttcacctttgataatctaggttgacttgacatttatgtaaacttttattatgcatattatcaaagtgaaactccaagttgggataaagaataatgccaaaagcacctatgcaactgtatgtaagttttatcctttagatataacatgttcaaattagagactagaagtaaattggttatcttatacagaatagaggactaattctgtcgaaaaacaaaattataaaactagatttcaccttcttttttatgtgctaaaactgatccaaatgacattgcattgtctttttgaaacagcccttcaaggacatgatcgaagggatgaggatggacctgagaacgtctagatacaataactttgatgagctctacctttactgttactatgttgctgggacagtaggccttatgagtgtcccagtaatggggatagcaccagaatcaaatgcttcaacagagagcatttataatgctgcattggctctaggcattgcaaatcaacttaccaacatacttagagatgttggagaagagtaaggttctttgaacacttcaatgcattgcaattaaaccaaaaacaataaacaaatggcattgaacctcttgtcactcaagggtatctcacatcacaattccaagaaatgaataaaaataacaacattaacaacaaaataacacttgtttcatacaatcaattaagccaatgcccctcaacattcaattttagaatttaattatatagaatatcatatatgaaaagattgtttattttataagaattacttttctaatataaaaatctttaatgtacatacatgaaagttaaactcttaattttaattgtccacatcattcaaattatgttttgtctaacttggtctagttcttgatcattatagtgctagaagaggaagagtatatctcccacaagatgaattggcacaagctggcctttcagatgatgacattttccgcggaagagttacagacaaatggcggaaattcatgaagggacaaataaagagggcgaggatgttttttgatgaggcagagagaggggttgcagagctcaactcagctagcaggtggcctgtgtgggcatcattgttgttgtataggcaaatattagattccattgaagccaatgattataataacttcacaaaaagggcatatgtaggaaaagtaaagaaactcttgtcactacctactgcctatggtttttcacttctaggccctcagaagtttaccaatatggttaggaggtaaccgttatacaatgtgtgatacttttgagttagaactgtatacatctcaagttaccagcatggttgaagagcaacccattcatttaatcagtttgcaagcatataatcagttttaaaatgtgtaaaaaaaagaaggaaaaatgtgttaatccatttgtatattataaatttcagagaacattcttcaaagggtaacaacattttacttttgagttacattttttatttttattttctggtatatgacttagagctttcttatcaaatcagaatttaatcatccttaattaattactcaaaaaacaatatatgaatttctttaacttttaaatcaatctttaaatcaaattaattgccattagatatttacaagttacctcgaaaacaatcttctgcaatttacttttgagacttttctaaactaaaagttttaaacaaatgtatttttttctcactaagaaaaactcttctattattgaattagtatttttctatcctatttatattttatttgtatgtaaaaggtcccattcaatgggggaaaacaaaaaaagcttggtaattttataaacattgcaaacttgcaagaattatttggtgattaattaagagtaaattacactcttatctcctctctttttttaattgcattcgatatccttccttttttacaccctacaaaaaatctcttaattgtttagctcacattacacatagactctctctctctctcctaaacaccttttgataatttaacagaaaatagacacatactagtcacatgatttttaatgaaaatttatgtctaaaacaccatcacctccttcctcaaaatcacattttggattttacaaatcttcctcttgtttaacaacccctcttcacttaccaccaccacctccttctcctcctcctctctctcccacgacaatatcatctcttcttctcattgtcgtcctcgcccacttacatggcgtccgagcgcacccacttatgccagaacgaccactgtcaccgtagccacaaccttcaccgtagccatcgtcgacactaccatatccatctccaccacctcctcgtcccttgccgtaacttcggtcaccatcaccgctgcctcggttccttagacactaacaaaagaggtaaaagtaatgtataaaaaggaagggtatcaggtgcaatttgagaaaaacataggagatgcgagtgtaatttactctaacggacaatttcgtctgctcaaatatttcaattgatattagttaacgacgttaacaaaaaaagttaaaagtaatgtataaaaagaaaggagtaccaggtgcaatatgaaaaaaatgcaaatataatttactcattaattaatcaatgttaaaagtggcaattatattatctagttaatgtgtgtggcgtgcttaagaggacacccttttttcgggttttctatcaacaagtttcttgattctcaattatatggtgttcaatcttctcattcattcctaatgtgagacttcacctcaaacttgtattataacaaatacgaacaaaagattaagaaaagaaagaaaaaatggagaaatgacttgccctttgaaatttagatcctcttactctggattaagataagaaaaaaaattaaaaatcttgagactctccatgagttgtgctggaatccatcaatcctttaatatataaataatttatggcttgatgtctgataatgataacataatctcacgtgttattgttgaaaagaaaaagaaaaactaatttcaccttttaagttggttggttcgtgtaacatcacaattatcatttcattacaactaatgacttcaacagtaaaggtgatattcatcccactagtctttttagatgcccaattatattatattaatatatcaattctaaaaaatattctaaacaaaactcaacctagcaataagtccacattaaacctttcattactttgttgaagataagggttactccttgttgcaactgaaacaagagtttagtttttttatgttttcaatatatacaattatttcggtgtacaatggatatatatacaatttagcaaggataatcaattaaaaatgactttcaaagagtcttgcatatgatctttaaagtaattattagaggaggtaaaaatttcaattatataacaatctataatcagataacaacgtaaaaaataaacacttttgggtcttcgaaaaggaacaaagatattactagaagccaattcgtcttttctttttcttcttctcttggtacaacaactataagaaactaaatcaagctagtaaaaatctcccatgttcattagaaaaaacccctaatttaacattccatcttattttttctaaatattccacagcttctacttgcaagttgcaacactctacatagaagaacatggacttcattttctccttactctatggttaagaccttccctacgagttgaggaagatgaggaagacaccgcagatgaaaaacaagaatggttattttcagccatatccttgtgaaatgccttctgcacatcatctttaagctccatgaagcgtgctttcttgattctctgctcgtcttcacttcccttctcaaggaagaaaacatctggcatttcgtcatcttccagaaacttatcaagcacttcagagcaatggggaaagaagcgcctaccattctcaactgtacataattcaaaaagcattctcagaattttaataacaacattaaaccaccatcattcttttcctctacaattgcaagttgcattaaattcatttccatttgtgttaagctgtaaagtactacaaatgcatggttagctctatcataagaaggaaagttttaagttccatttgatatcttatttggtacgctatgatatggtctacttagattatgagaaacaatattttgtttcagggtgttccttttaacttcactagcacactagaaatctagaattgattaaggttggatcgtagacatgctttaaggaaaaaataagtagtgttcaatgctccttttctgattggtgtactaatcctataacttgtctcttatccctctgatttggtcttataacactcttgtacatgagttagagtatcccttgcactgtgtttttaaataaactttgcttatatacaagtgataaaaagtttctttgttaattagtagttactacactccatctgtgtaagtggaaagttttatttttacttttttgttggcatgcatcatgtaattctgagattttcacaattgtggcatgttccaaccaaggcaacatacaagcaagctagacttggtgttaatagaataaatcatatccacattccacagatgcataacctctataaggatgctatttcaaaattgtcttggacatacctgttttcataagggcatgcaatcttaactggagttttttggttcgagcagagggagattcatttagatctacttctttcgggttgccatttttgcccttcaaagccgatgaatatgcgtacagcgatgatgaatctgcttcagcattctcaatggctaccctagcctcagcaggaaacaacagccgagcaaatgtaactgcaacatatggagcatgttaatttcatgtccataggcttccaaatttaaaagcatcatgcaaatatagttttgttgtggttatgatgcatgcatattcctaaagtaaaataacagcttactggtattaactatgcatttgtaattaataagttaccattactactgtaattaggaggatttgattgtgcacagatttattcccgatttggaatagtttcattagagtttatatatttgtatcaatctatgtatttttctgaacaatggaaaataatattctggattttaccctttcaactttccaactcaactaaaaggtccaaaacccaatattcatagaaacaaagcgacctagacaagagaaagccctacctctatcttcaaggtaatccagtctcatgtgcaaatcatcagctgttaactgtgatgaaacagacatattcacaatcatagaatttcttctcatctccctctccaggacatcaacacagagcctgtccttgttagattccttacactgcactgttttctcatgataatccttgcatcttgtcaacctctgacaaattgcaagagcggtttgtccatctggagtggtatctgatgcacgtgcccctttattcagtagtgctaccaaaatggatggatcctttcgccttgcagccacatgaagaactgtgtatcctcgggaatttctacgaagaatatcagccatgcctagactaagaacttcttgaataaccttagaatcgctataggcacaagcatagtgcagggcatatgcatcatctagagtgacactagactcatttagaagaagcttcagtagctcaacatcatcagagtccaatgccttgtggattctcctgatattcttttcattcaaggactccacttccattgcattaggtgtggattctggctgaaatgggagtcggagtgatttgatttcagtcacaacttcatgagggagctctttttccaaagatatgttgtcaaagtcagaccttgctactctctgaatgcactgagagagaagctggtctagttggcagttgaaagcagccataagaataggaatgacatcttccacaacagccttctcaacaaaatttaggagatgccgctgcatcagtaaagagatatttacattagatttgttaagcaaaagatgtctgtctttttttttttttttgggtaataatagagaaacatagaagtaacagagactgtaatataggatctaaatatcatcctcaagatatatgttagaagttaaaagcagcagtggaaaatcagaagagcttagtggacaaaggtacataatgtagtcacaagtgtgcatatgtgtgtgcagttaggctaggtgtacatctatttcaaaatttgttcactaggcacataaagtgttgaacaaattcagaaagacacacatgtaagttggaaacaatttccaaaacttgccaaatgtacaatgtttatctgcttttagtcttaggtaaacattgggatactttaatgggtaggacggagatacaaggtgggttgaatggttaagggagaagggaagtggaggaaaggtcacaggttcgatcccctctactaataaagctagcattctaacaacaaatatttgccgataaaaaaaaaaaaaactttaaccggtagtatttctatgttattcagcccagaatgattttgtagaattgctctgaatttgtcaaatttcttctctttcacgcaaaaattagtaataagataaaggaagaagaactaaaaatgacaaccaaaatacctgaaaaagtaataccagctccttcatctgaaaagtggcagaagcatacatcagctctaaggcataattgatagcagggcggcatgctacatggatacatgtttcatcaacacatgttgtctcttctgttggtgaagcctttagccttccagtatacagatagtacaagaacacttggaaagcttcatatccaactgtgccataaggcaccaaatctgacatgagataccttggctttccttccttccctgatccatcagtccctttcttaaaaagctcatgaaaaaacggactacgcgacgccaatatacagcgatgtatacccacagggatgtcctcaacaagaatctcagcatcactataaccatagtcagcctcaatcaatagcttctcaaggcttccactgagcttattcagactcaaaatttcaatatttgccccatgctcattgctggtggtggaagacacgttgtgattactagaaccatgtgacaggtgagatgatacgaaactcaaggatgatgatgaatcatatgagttatccatgaccccaaatatacgagattccaattgagtcaaagcactgtttgactaaatttagaagcaaaagaagaaattaaacccctttaagtacccatctcaattgaaaagctagctaacacaatctataaccaaacaaactaagctcaaattaaataagcaaaattgagaaaggtcactgtttcgccaaccacaagaccaaagtcacttgcaagtcaagcaacaaaactcagattcccagaagcaaaaactgatatgaattttcatctggggatgatccatcaaataaattgaggcatgagagcaaaaaagtttgaacttttagaacttaactgacatgggaaagatgttaagagcaaaagcagaataaatattacatacagggtgttaccctttgagttaagacttaagagggaagatgaactcaacagcagcttgagagaatgaaccaggggcgaatcttgagtaagagactcttggaagaggcttcaaaacgctgaagaagaagaagaagaagaagaagaagaagaaactgaagaagatggctagtttaacatcaataatgctcaagtcctttgaaccaaagaagcgaagacttgaaatggaaagagaaagagaaccaatgaacaaaggttgaccaacgactggaaagagaagatatgggaaaacacagagagatgatgctcggtaaccgagactccctgtgttcttgaagagaaagaaaacgcaaactacacgttgaatattgttctgtctttttctctttttcttattcgctctcaaatttctcgttttgttagcatgacccaaaatttaataaatattgtgaccatgtccctagttttcatgtttcagcacaattattaatgcatatacaaaacatgtgattggaggaggaaaaagtagttagggaatttaagcataaaaagttattacattcgtgaatcacttaatctctcgcacatctttgtttgttcatttaattcatattcaaaacgacaaatttatatgtcaagtgtatttttgtgttattttttattattaaaattggagttttattttaataatttatgtttgtatgtgttaatttatttttcaaatcgaacttttatctcaataatttataattatatttaatgaaaattttatttataataaaaatttaattgaaaacaacacttaaatattctattttacattaaaatttaaatgagttggattttgaatgttgaccgtctaattatttattaagctgcatttaaattttgtgatgttcaaggtgctgtttttaataagatgaaaattgtgtgatagtttttttttttttataccaatttcctaatgcattgcaactgtaacttatacaaaacgcaaaggattgggatgcacattaaccgcatttatctttttctcttttcggcaaatggtgctatattccgagttatgagagtgtgaaattatagaaacaaagtttggaaaaaaagatgcgatagaatattgaaatatttgtattggccaaaataggaattcgctctgctaaagggatagtaaaaactttagttactgctacagagtacagtaatgtaggtatcatcagctttctgaaagcaagtgggtccaacgtaaatttgtttgttttggataaggatttcagattttcagtgcagttctacgttccagaacatcctaaaatgaacgtgctaaattgctaataacaatttcaaaaaggaatattgaaaaattgcagattctccaacacaaggagcacatttaattacgtgcagatagcatcgttgttcgattggaatttaggggtatcaaattctaggagggggtggtttcagttttcacatttgcttttttttttttttttttacaatatttaatcattattgatcgtacaaaatctaaacatatgtcaaacatatatatacacacacatgttggagaatccttgaaggcttgaactcaattcttggttcttaaaattgagataatttctaaatttcgatttttatgtatattgttttgttcattttttatacctctccaacgtttataaccatttatgtaaagcataaagtacttatttatttttcattaaatttcctgtcgctgctgtcacatttcatgccactaaggtggttggtatagatttttctgaagaataaaaaagaaatggtgcatcatcctgaagttttcttaattatcatttgaaacaattaaaagaacatttaatattttgataacttaaaaatcttaatactttattccttgaatgaatagttaaggttttaaaatacgtagtatatatatgagttcttataaattcatcacatataaataaacagttaagttaatggtagaaattggaatagatgcataaagattaggttcaatcttattattatttgtttgatacaagtgagaaccagcgaaacaaatacgagtatgatgaaagaagacattaatttcaattgttcttttgtttggtattgagggtgggaaaggatgaataaaaagaatgtgaaattcactgttatagtaatctgtccattttggttgggagagagaaatgaggaaaaaaatgaaaactattttttttttacttttatatttactttctttattacgaatatttatctttttaaggaagagaaaataaggttctttttttatctttttgcttctttcctatcaaatagtttacaaaatccttttgtttataagaaccaagtgattattagataatagatatctttgtagagattaaaagctatttttgtttttaattaaataaacaaatactaaaacggagtatatatttaacaagtagaatttcaatagtttttttttttataatgtttacaatcctatcctatttatgctaccagcgatcttagaagaaagaagatattatcagaacgaacgatgaaaagccacgtggctaaatcgcagttggcttagcagcgtgagcgaagataaactccaacgcagcggaacacgtctcttccaaggggacaatggcggttgtatccacgacgagctttggcacgtcaccaacgtcgtactccgtacaccctccgtacccttccagaagcttctccagttcctcccacgtccccggcttgtacggaggagcggagagtcgaggagggcgctgaggccgaggcggagctgcgtggaggcgatttggcagatggcgtcgtatgagagatcgttgaggagtgaggcgggtgagtttagagtagaagtgcttttgaagatttatctattgaaaaaattttatatttttaataaaaaaattcccaaaatcacttataacttttattcaaaagctctgtcgagggattcgaagagatgaggcaatggactttggcaacgtgctttttccgctgccatcgctattatcactgctgactctaattttgccattttcttccttcaaagagccgcaccacaccacacaccacacaccacacaccaattcgatatttggatgcttatccttctattctcatcactgctggtaatgttctagaatttctgattttttcctcattcacaagggattcacttgctaagtatacttctaataattattgtccataacaaattcatcaaataactaaatgaataagatatttattataaaaatcatatacaagtgtaaaaaaattatgattaatataattttacgtatgtcaataaaaaatctttcttttctttaactattatcttaataatactgattagcatctccctttaatataattactatttaacctcctaattcctaaagtgaacatctctcttaaatatttataaaataaatcaagttttctcttttaaaattaatttatgcattccatctttgaaagaaactaagtaaaatattttctttataaaatataattgtataatttgttttatattatgcaaaaaaattcaacttatttcactttcttattttcttaatgcttctgtcattattataaagttcaaataaccaatttatcagattaagtaatttgattaaattacctatataagagcgttaaatttgtcttaaaatactatcttttctcatacaattattcttttgaacaaaactaacacacattaatgaattgtgtttctctccataccatgtcgttttagaacggactttaatagaagatatttttgtaaaaaaataattaattcaccaaaaatttcagattgcaccttataaaaaaaatgaagctatattttttaatttgaaccttctaataacgagtactagatgaagtatgtgataggtgtttaaaacagaattttactaaacataatagttttttcaaacaaatgtgaatttaatagttaaattgcaggatattgttttgatgaaaatatatattaaattttaaaaaatgaaacacttatatcaatataatttcatatttaatatttattttcaaaatattatacataaaagtaaaattttaataaaatgttgatcagtttttaattttcatgatttttataaacttcatatattgaataaaaatgatgaattcaaaggttttgttagtaaaattttatgtttataaacacaatgattacacaaaataagttcattaatatttactcttgtttgaaaatatatgtaattggaatttaatatatatttattttattgtttgcaggacttgtacactttatgtgtgtaatatactagtcattatttttatgagtaatatttacacattcaattaatcaattagttgtagcatgtctgtttcaaaaaaaaaaaaaatagttgtagcattttttggtatatatgaaacttattcccatagcattcttcctattttattattcatgtagtgagccttcgattaagtgtatgttggatatatttgtgttgatgctacattgattattttttcacggttataatttgttgcttctaatatttcaattatccaccaccacttttgctgttggattagtatataactttaagtatatatgagtgtttttcaaatgttcataacaacaaacatgacgtgttaaagcacgtgtactatactagtgtaggttgatataatacagtttcttttttgtgctatagcacaatattttatctgatgccatagataaatcataatttttgttttgttggtataaggcagacagctaatagaatgcagagtgatgaatacctacttgtgctgtttagtctgttgttgggggaagtatttgtattctaaagtttaaacttcgaaatatgccattgtctcttactttgttaaagtcaaaattgttaatgtgatggtaatgttatagataatttggcccctaacattaatgttttgagagactttggtgtgcctagtgcctccagcttccatctgggttcccatttaagaaaaattcaaaatttgaggaaaatgtcaaattggctaaggagatgcatcttttgtctttgttatccatgtgcttatcaatttgaaaagagagctatgtggggaatccagattagaggcctgcaagaagtgggactgatctcaagaaatctctttttcaatgttcgaagttgttgtttgcaagcatactctgttgcttgctaaagcatgtggaggggaccaataactggagtatatttccatcaaatcaaatttcattgcattgtgttagcatttaattaagcactctggtatataattatgatgttcaagtttaccttactatttagctatgctaccaaattgaaacaataccttatatgttctctctgccttgactaatgaagaatcattgaataagttattgtttcaatttaggtttagacgttttatttctatggactatgtaccttgtgtcagttttatctttattattattagttattaattattaatgggaatgttatctgtattagatctgttgttatatagtaaagaaaaatgtttcattgatactatgctataagacatctggaaagaaaaaaaatataaatattataagatttatgatgtaatagaaaaataaaaataaaaataaatgaatgatctaaaactattttttctctaatactcatccttcatatatcattaagaggaacatataagactatatgctccccaaggaaaaaaccttgtttaattaatgttggttatgtacactaatgatttggatgctagtatcacagactgttgtttataacaccaattttttccactaagtctaagtgcagatttgaaactttcatttttatcacatatatacagaatggtgactttacaatttcaacgtgaaattaacttgattcatgaaaactttgtgtacacataataatagtaataataataataataataataataataataataataataataataataaaaagcgtgacatgagcgggtttttttttacgacatgtagtcttaattaccatgaacatcattattccttggttcacatgataaggcaattgtcatgataaggtaatcgatttatattgtatatagcacataccttgcttgagcacgacgttttgtgacctaggaagcatgaaattaactcttgtcccctcacaaccctcgttttcttccaacaacagatttccccattttccgcaacttccaagagttttctgcactcaaacactcaacacccccttaaccaatgcagcataactctcgttttttagtttcaatcacacatatctcactttcaagttcaacaacggttactgaatagtgatattatctttatacgtaaataaatgcttcaaattttaaattgattttatatttgtgaaaaatgtattataaaggaatagatttgaaattttacttgctaagtcactacaagtaaaataataaaataattttattttttaattaaaataaatattttttaataaaatgttttatgcttttgtttacctaataatcaatgttttttttatttacatatgacatagttgacatataatcatgttccttaggtatatgtttaagaattccatgtttgtgtgtataaaagacatctctcaagcaataaaaaaagatctattgaaacaattcaatttttaataaatctagtatcttaaaagattaattactaactcttgttaatattttaaataaattccaatatcttaaattattagttattaactttatgctggaactggaaatactctgaattcacccaaccaatgctttacttgggcatgttagcatttgttagttcatgataaaatgccatataaacaacgttttataaatgccaaaaaaaatgtgcaaaatgaatttttttaggagaacattaaatacattaaatgaaattgaattaagtagttagccttattaaattgaaagttttcgtctataaataattcttatagtacctgaaaacatatcagtagttgtctgtttattcaattaatcaaagaacctaagctcgcaaaattgagaactgacttcttaatttaagttgatactaaacttgaaaaatctttaaaccgaatctgccatttttaattttaattttaaattgaaaatatctccaaaccatccctattataaataagactaatgttgtacagtgtacacagtatcttcttgttaattatcccaacatttcattaaaaaataaatgtatttaacacctcaaaaatataaaaaaatttaacattttcttcattaaataaataatcagccaattatcgaattttcagaatttcaaaaacatttttattcgttaaaaattactagaagaaaaaataaattatacactaacataaagtaattattcatcatcattttagtgaacttttatttaaaagttatattaataattatttgtaatttttttatctgtaagaataataaagagtagtaaaaaaaattataatataattcatgcattttattttattaagttaattaaattcctgataagtgactaaattttatacaacaccgataaacacaagctagaaacatgaaattggaacccagtacccaacacaataaatgagatagatttaatttaatttaaaaaagatctactccatatttgacacgtaataattgaaaatgattgatgaaagcgattgaatactgagttagctacgagtgggagtggaactatttttctttttcattttttatttattttaaaaaaaaaaaaaggaagaagaattgagaaagtgtataaaagacgcggggtgccaaccatatttcttcctatctgccatcttcctccttagcctcacctcttccaatcccaatcccaatccaatccaaacatgttagggttttcagtgttcaaatttccccttcccatttcttcaatcaacataactcatgcagcatgatcccaccaccttcaccactttcaactccaaatttccttacaaacgcactcaccacccaaccgatcgcattcttcccttcgccaaactcacgcctattcgcccttcctcggtacttcacttccttcctttttgtctcgactgctgctaaagctttaacgattcgtattttttttttttttttttagttcgtgaagagattttactcttgaagtttggtgtaatttttttgtttgttgctgtccctgaacttacgccaatgagttctctgtgtgggagaagtacaaatagttggtgctttgaagatccgcaaggatttcaatcccacttgatcaagtcaagtggttgcgattatatgaacttggttgggtgctggtttggtgtggaaaattagagccctatttgaattgcatttggtgaacttcaattcttaaatgatttaagattttcccccatttttttattattttttactgtcttttgtcagcttcacattaatcttagtagtaacttatttgattttctggagtggtaactggttaggcttgatattaatggataaattttttattactgatatttaggtctaaagcgaattggtatatcatttttctcttaccctctacggattgataatttattccctgtaagtattaataattgaatttagcatatgttggtttggttggtggatctgcggtagtgttgttagttgttattaacattgctggatagcaacatttggaagttggaatcgacctttgggtgaaacttgggtatgtatgtgcacaggatatgaagcatttcttgtcttgttaattgatttcagaggttttggatggagtaaagaggaagagtgttatggcaattcgacttgtatgcgaacaaactttttggtgtctttgttggatgctgaatatttgaattttctgttggatgttcttacctttttagagatgatttggcataagattgctttgaatgagaaatattagcagatctatttaatttaggatgtggactatccttttctgcaaggaggataccctatcctccaaattccttgtatttcttctttccttatatatgaacattctggcttctccataagaaagttttgattaattatctgatgtccttgtctctttggcacacaatagacatatacttaatatgttaagtctctttccctcaattaatgtaacttctttgataattattgttatccttaactcataagtcattgtcatagagaaaccaaataaggattcatctttggcttttagtttttgaatatcttgtcttcaaacttgtatttattcatataacaggagacaagtgtaaaggcagaaaggttgtaaaatcttcaaaggatttctcatttaaggggtggtattgcaatgttagcttctaaagaaatgatgaaattcaaatcctaccagaaccgggctaatttgttcgtgaaggaatatttgttagcagaccctctgattccatatacttctattattggtggtatttttgcttgcaagatggtatgttgtattaaattttatcctcattctattttctaaagtatttcacctgacttaggagcttttaagattactgctatttattatttttattttacaattatctctaaatatttcctgtttttccaggtctatgatcttactcagctttttagcactgttcactttaagagctattccagcctcactagaatccaacgtgttgagtggaataatcggtgaggggatgttttcatttggtggaatgtttcttaatttgtttctgacaagataatatgtttacaatttttttcctattatttgtgcagttctatgtcaacaattcattctattttcataacaactatatcgttgtacttggtgttttgctcaaatctatattctgacaaccagtcgtcagaacttattacatttcgaagctcttcatcatctacctttgctctgggggtaagaatgatgtggaccctttacaatttgtttcccttttcttcctctttgtgatttatctctgcaggtcaccattatgataaacaataatgaataatcacaaataattgtctcacttcactgcggaggacatgtcaataaatctagtcacctaaccaatagaatgaagggatgaatcatggagttcatttttattttaatctatgactctgccaagtggggttagatattattagcatcatcttgatcactgactttttgccatatatattttctgatattgtcgtgaatgccatgatgtagtggagttccaaaaagtacgagataatatacataagattattttggagattttggtgggcttttcatggtttgacatttttatgatggagatattgtaagttgagtctgaatccctagatatactggaagttaaatttggagaacacccatgccttgttatgaaagcaagacagacctagatgaaatcataggctgccagggtaaaagaaaaaaatattttatgaaaattgttgatgagtaagtatatacgataagcaagtaggtaatgttaacttccatgaagtagaggattgtcttttgtagtccatgaatggaatccagcatggagatttaaggtattacgaatgtttcttagaagaagccactactaggaaggttttttgtataatgatcaatgcaaacacccaagacttgatcagtaggatactagtgatgaaatgctatttgccttcagctgcctttaacttgctgcttgattttcataatttgttttttcttctgaaagatttgcttaagaaagaaaagcaagataaatagattcccgtatgttttacattgtccacttttttaactttaaagcgttctgcaattgctcttcagacctgcatacttcctagagtaatgtaatctatttgataattaaagtacataaatgacaattttttattagcgtgaaccatatgttgatccagagtgtgtgattaatgcaattggcattggttggaccctagattgaataagttagactgaaatgttaccaatttatcatcatttctttatgtgtgtgtagccatattgtctgagcatgttaacaaatattattgacatcttatattaactaaatcactcttctcatttttcttagtatctatatcttctgctaatttccttttagtacctcttctatatgttgctagtcatgatttacaacaaatttggacttgttattcccttgattttactgatacatccaatgataacaaaaagtatatatcttacgtttatcgatcatcatattatgagctgcaacacatttttgtttttatctggtcatgaaatttgtattatgttttaatttttaatgtgacaggtgtctgtcggttacttcatcgctgaccttgggatgatattttggttttttccttctcttggtggatatgagtatgtaaggatcatatcttttgacttgcatagtttaaaccaatctaaccttgatcatctgaactctcttaatcaattttaagatattccacttgattatggcaagagtttggtttccttcctttttcaccctatttggttgtaaatatgaatttaacatgacttcatattaacattgattcaggtgattcatcatttgctttctttagtagcagtagcgttttcaatgttgagcggggagggtcagctatacacatacatggtcctgatctctgagacaacaactcctgggatcaacttgagatggtaatcttgcacctaaatgtgcactatatatgtcatgtaatttatttactaatgcacatactgtgtttgtgaaggtatcttgatgcagctggaatgaagaagtcaaaagcttatctcatcaatggggttgtgatattcattgcttggctggtgggttaagtcattgcagtttgaaatatattgtcactcatttatggtgttatttgtggaatcattgtgaattgcatatcatattaagtatatagcaatctcatccgtgccatcttggacatgctaactgaaatggtcttcctgcaggttgccagaatacttttgtttgtttacatgtgttaccatgtctacctgcactttgaccaggtaataactactgactgaatttaagaattgtctggtatgtggtgctttgcagcaagcagatcttaatattgaatttttggccttttaagatggctaataatgttttgttgcccttctattggatgtatttgttgccaacaagatcactttttgaacttgcatgtatgtgtgtttgggtgcatggatcagcaattcccttggtttggttatgttcaaattgtgaagaaatttttaaaattttgtgtgggtcccacaccttttctacactactttaattttaaatatttcttctcaattctccccttcccttccattccacacaaccaaactcttccttagtgtggtagtctctgtccatttacgcatgtatatacttacatagcattacctctacataataagactgaattggtagaacttgttccaataaatttacaatttgactccttgtttgcttagacgaatgttgtcatagtagatctatcatgtcaactagttagtcatgaaatattcatctcagaagattgttaaaaatacacctggatgtgatagggatagggagtggtttattgtgaggtatgagagttgttaataacgactgttgcattttacgtgcatagtcaaggagaatgtgtaatgtcttcattttgtaataaatgttttagactttagtcttgcatgggaatcttaaaaatggtttatttctttctaatttctggtcaagcaaagtctactttataaagcttaggatctcacgtcattgttcaattattcattcaacagattgagcagatgcacgcgtttggacaagtgttagttattgttgtgccgctggcgctatcagttatgaacttgatttggttttcaaaaattatcaaagggttgcggaagacgttggcgaagaggcagtgaaaattctgctcagtgatattattttagaaaaatgatatacgggtcaatgatgtgtagtgaaagatgtaacagaacagaaaccattgaaagtgtttggattccctgtggatccgaacttgtacaaagatgttcattctgcctttttttttttcttcctattaatgtacatttattagtttaattttaaagtatttcgttccatttgtttggcaggagaaattatcatatgattcgggaatttttggtcaatcttcatgtgatatataacaagatcatggacaccacggtatttaatttctggtttgccgaggaaatgaagtattatatgtggtagcaactagcaagtgtaccatgcattgatggataataactatccaaataagtacacttggcctctttctccctcttaaggaaaaaaatttaatcctaatccatcgattttatcaaaaaagattactttttaaaggtgagtgaagtttagcttatagaggactaatggataactataatatctagcataattaggatttaggagcaggaagacgttcgattgtttttctaaggagcaataaaatgttttttttttaaatgaagtttacacctgattttatgaaatgtatcttgataaatgaaatttcatttgaaggaatggctttcggagttaatacgcctgatttaaacaattatttcaattatgaattacatacttttataagttttattttatatctgcatgggtcagttttttttcatgaaaaaattgcttttaatttgaaaagaaattacttatataaaattttaatatgtttgtcaaagtttttcttttcaaaaaattataatcaataaaatatattttataattatttttttaaaatgttacatcaagattttaaaaataaactactttatacagaattttaaaattactatttattttttaagtttcaatatacgggccttagtggtttagatagctagcattataacgttgtgacttacatagtttatttttatattataaataaaaatacacaattaaaaaagtgtatttcacttattatctctataattactcaaaaatttctctccattatcttaaacttcctttcttttatttttatttgcatacttaatttcttaactatttatcattttcaatctattttcttttattttcattcctaaattaattttttagaaattgtcaataatgtaatataatttatatttaaatttaaatttaaataatttattataaatttaaaatataatttatatattaaaaaatatttatttagtattaattttgattattatcttgtaccattcacacgctgaaattactagttaaatgtgatgggttgaatcatgttataaatgtatggttgaacaatttaacattgattaaatggagacaagttcaaacagtatgcaatccaaaggatcgttataccctttttttttcctgcacgtgtccaacatatatacaagctagaatatttttgaaatgttagacataaaaataatcactttgcctttcaactggtttcattggtatgggaggtatcatcaaagatcactattaaccgagtttttggttgctatggctctacaaagatataagatcaacattggggatatcagatttgggttgaaaagaggctacaaagaccatatgtagcctttttttttttttggaaaaactttatacactcaacaaaaactaatacatcattccaatacaatgcatttttaaaaatatctttgttttattacatgcttcaaacatatgattaacgtgacactccaaccaactgacataataggtcaattatgctaaaaatcaattaatgttgatacatataatattaaaacttttaatgtatatttaatacacgtataagtttacataataaattttgtaataattaattttgatataataattaaagtatttttttatatataaaaatcataagtttaataaaaaaattgtatgtctaataaaaattatatttgtatttataggctaaattaaaaattatatatgtatttacaatgtaaattgtagagaccatatgctcaagtccaatatgactatacatatatagataataacatttatcgtttaagtataatcacaaaccagataaagtactggagagtgtggagacgactggacttcgtccagcttgctaactaattaactttcttttccatggaagatgtacttatcacaaatttataatctgttcaaaatgattttaagcttttacaatttctgatattttataaaatgagaataacattatcatgtgtatgtgggttattatagctagatcgatcgatggaagtttatcttgattctattttaggaaattattgaacaagagaatacaacgttccactttatcaactaatattctaaccccatagcacaacaaaaagaaaatcctttgcttgtggaattggttgttctatagctagccaataataagcacggagttatgattgatggtgattatactcatcacatgaccttccatgaaggcatataattgatttagagatctggataattagttaaaagaaattataattaaaattgcagacggaggctttattgataaggtaaaaaggtaaaggagttgctacaattgatacttggtcaaagtatcattaatttcaaatgtgttgtctaggattgaaattcaccacaatctgcgtgtgataactcctagaaaagaattatgctgttttctttaagaataagacatgtgtgaaaggttattcatatgatcatgatggtgctgagttgtttacagtaaagatgcatataatgtgattgaatctgaaaagatgcataattaatatgatattttcattaaactatatgcaagtgatcaatcataagtagaaagttgctccaactcaacttgatcgatcatcaccgttagattttaatttccattaattaataagcatggtttaaattcttgtatcattattgttacggaaaaagaaagagaaccttttattacgcctaacaagcctaacactgtaataaagtacactaattaactaactattaattgtaagtccttgcctaaaaagttaacatgtaattaaaactagtgttacgcacgtgtaagtaaataaaaagaattaatacgcatattcagattgttaggtctaagtttatgtaattgtttgcaaaagacggcgtagaaatagaatcaacggaatgattagcagctgcagttgatgacgaaaaacgcattatctctttgctattctcactttgcataatggacattagaggcgtgctgaaggagaaagatagatcagcaaaattttcttcttcatttgacacatcatcactaagcaagagtccacttgactctgattcctgcaaggttccagaatatatatattttgaacaaaaaatatatctgtgaataacatgtaatgaacatttatattcttctctcttcttcttttttttctttataataaaaatgttaaatttaatacgctgtattcaaattcgtttatttaatcaagaataaagaatgtaattattagttagatcatgcaatatttgtatacaaagcgtattttccgctttgatatgttaaatttaaaacgctatattcaatatttactttcttatgtctcaaataaacatataaaaaagcattttgttgcaaaaaaaacatataaattaaagttagtctttattttctacgttaattgggactaaaattttatgtgccaagcaaaaaccattccacctgccccatctaacaattaatttgaagtaagctaagttcttaatttgaaattttgtaagtgcaacgcatggaatataaactacatggacattttcttctttccgagagttcgtatgctaaaaaaatgtgtaatttaattataaaaccattaataatagaagtctaattaataaaaaaattgacttgtgacgaagtgtttatgtgtgcgggaatgtttaatattcaacttttaataccgacaaaaaaaaaagtttaaagtatgtgtatatttttgcagagatatttcagcgactagaagcatcaattcaattactaaattgtcatcaagacaagaacataggttttaatttgaaacattgcgtttcatgcttttacaacataagatgatcaatgaaaagtcgcaaaacaaattggggagacgccaagtgatatcaatattagtttaaaatagtacctggtttagatcataatcagtttcttcccgcttcagaatcctgtttacataatttcatagtcataaagcagttcttatatatatatatatatatatatatatatatatatatatatatatatatatatattaaaaaaatattaaaagttgttcccagcttcctatcgatttgatgagcatattaaaagagtatgcaaaaggtaaataaaaatgtgataaaataactgattcataaagtgataatagtaaaatgtagtacttcatgatgtaacatattcaaatgacatttttttataatggctgaagttataaaaaaatagtatatataacctaattcattttcaaaagctaattccatcaatcaatggagcattatttgcttaagttttatgagaagtatattaaccacttttttaattattgtgagatatctaactatacttctctcatgcctaaaacagttattataacttaaccggtatatatataacaaaagaaaaaggaattaataaaatttgagtagtgtcagaccatatacataatcattaatgaagcttgttgaaatagatagtgatccaaccatgagacttgaataccatattagacaaaaaaattgaaaagtagttcagaataagaaaatattgtccaaatcctaaaaaaaatattttgattatattcataattaatcaaacacaactgtaactataaagttatgtcttgataacttgttgattatgaattcgaatctagaaacaatctttttttaagataatgggatacatattttttttagttcttttatccatagctaatcaaagacatcttaacccaatatcctttgaaaaatcagtaatgggttacctttcggttggagaaatagagcatattttgaaatcgtttgcctttcctaccagcaactgatccactggtgcaataatggcatgtcctttcctgtttctgtacatctaataaaacgcaaaatttctctttggatggatgtaggaaaactcaatcatgaattatatatactaattcaaaaattaattaatagaagaaaggaaataaataatgtgtgtatatatatatacacacgcacgtaaataacattataattccccagcagtggtcttgtgtttgatctcagtatttgggtataaaaaaatattcttaaaacaaatttctgctttaatttctgactttactctggatctacttaatttcttacttctaaaataattaacaggatactgtataaaaaccacaaaatatgagtagccagcctaatggctctgagcttatctaggttgcttcttgatgatgatgatgatgatgatgatgatgatgatgatgatgatgatgatgatgatgatgatgatgatgatgatgatgattaaaaccaagtatgatttgaatattggaacacacattgtgcatgcgtttttgcattgttgtcaagatgagagagagaattgaattaatttgacagctgtatagagctgcatatttggctgctttgatattgttactcaatgaaacaaaaatcttctttttctttaaatcttccctcttcgtggagcatgtgtacctaaatattcttggttaattaaacaagatcacaaattattataatttttttactgtttttaatttttatgaataaaaaaatatgtaactaacctagatagttaattgtatatagatgtttgtattgttatatactactatatagttcactgtgcagtgacttattatcatgttctccatcaattatgatctttttgaaagaaggctctatctgctttgttgttttgcttttaagcaataattactaattaccaatgtattagctaggtctttgttatttattttcccatttaatatagatggaagagagatgtgaccttaggactaaaaacggagaattaataaatctatacggactttctatgacaatactatcctattatcatatcagaaatatttttaagacttaaatattttttaatctttataatttagtattttttagttttagttttataaaattattttttaatttttaatttttaagattatgtttgttttattttttatcttcatgacattttagataatacttttttattcttcaaaatgttatatatctaaagagttttaaggactaaaataaaatgaatataatttataaggattaaaagtacaaaaataattttacaataaaaaaaaattactacattgaaaagaaaagaaaatgtatttaaatcatattttaattacataataatctctgcacgttttagaactattttactagtactgttaagtgatgaaagaaattggtgctaaattagctactatacgtatattaattaaatcttcctcctcagatgatcatgctgagtttccattcacaaaaaataataataagatttggaccacacgagtaagatatatatatatatatatatatatatatatatatatatatatatatatatatatatatatatatatatatatgcttacatgcatacctgaagatggcttttgatgtgagcgattctcaatcctttcacacgcatctgctgcaaaattcgctttggagttgcctctgcaaaaccattttgctggatttatacatttgcagcttaattaagcatcccaattcacaaacagttcctttccttcccaccttaatttgatttgatatttcaaacacacacacaaggctagagaagagaagagaggaaacgaacgtatgcttcatctatggatatatattatgaaccaataattttctgctatatacatgtcatagatatgtgctattataaattatattgcaaacacgttaatttttctcttctcagatattgtggtatgcaataagaattagaagataaacaagcaaactcaaagaaatctagaaatgaaactcagacatgcaaaaaattgtcagtcaacaaagcattaaagttaaggagtcaaggacaattctaaggttggatcagaagaaatcaaaatgaaagaatttgatcgaaatcatcaacattactggcttccttcgatcaaacggacttttgtatccaataacatatgctttcattaactgattttgggatatgcttaatatactatacatataatttgctataaaccctagctagaattataaatatcttatatatttgtttacatgaaggaaattaaacttactttgttttccacctaaactttcaatagcttcaacaaagtgttgatgaagttcaggtgtccaccgcaggcgtggaagttcagatttgttgtattttcttacactgcttttaatcatttttctgtgcttcacactgttacatatgtgatatgtaattatgtatagctatagtgaacctcaacgcgaataataagactggtctcacctatatacaacatttcaatatgaatgctgcagcaacctccaaaagtccaaggccaatgacttttcaagaaattgaattaaataatggattcttaaaagctgaagcgtatattgcacataaattctttttgtctatttttcaaagaaaaaaaatcgcttttgttctccaatcgatcattccatttaaaattgacagtatacaaaagatggaatgtgttttaaaaagatgatatttgttagattcgtccaatgacgcgtttcacacagttcctatttaatagaagaaaagtactaactaaatattttcaaagcattgattaaaaagttaaaaataattttttataaaaaatatgaatttaaatataatatactaacaatctaattaggaattatcatataaataaaaattattaattttataataattaatttaaaatttataaaaaatgtacattaataacaatctgttaaaattaaactaaaaaggtctcaactacatatcctagtggtcatttttaatgtaattctatcataattttaataaaaattatttatttataaattttagtatctttaaatatttgttaatattttttggtaggttcatttctttttttggtgggtacaaactcgttaatacgtttcttttcatagcattattgatccgaaaatattggcattcaccgacagcaattgttcctttcacatttctttattgtagttttcaaaacatgagttgaaaaacaaaaatcaattatgtaaaataagaaagttaagcatatgtagatcttattatctgaattaagacaatgttaattatgataaaatgagatttaaaaataacccgtccctatattataaatctaattcagtactgtatttatttttcaacataaattaattataggatattcatattaattttcttttatgctaagatttctttttcaaatttaaaccttaataagtttctttttaacttttatatagtatcgactcatctatttacattcttttaattttaagttttgaaaaaacttaaaatatattttaattaatacgatattattttattaaaaatttataaaatgttattctacttaatgttgtttaaaaaagttaagtaccaattataaaatgataaaagtaacttttatttgattgaatagttaattaaagcaaaaaaaaacattgatttgatttaatatagatcaattttttaaaacacgtgccacataatattaaaaaaaacacatcattatttaaatttaattaatagaaattcgaaaaaatgctttattttcgtagacacaaattcatgttataagagattatttttatcctcctttgtttgattttattaaaaaacaatgaaaaggcgagaagagtaatattatttgagcatctaaaaattgagatatatatgtcatatataccacatacattaatcataattatttttctcccacgtacctttttatgttttttgcatccacttataatacacaaaaacacatctcaaatgaaaaggtacatcattttattccccaaatggaaatatgtgatgctgcttggcgtgggaattgcgtaccttgctttccttaacttgtctctccatcaaaataatcaaaaggggggaataacctattgtatcatcacaaattcttcaatatattactaaactgccaaacttgcatggatgaatttcctcttcctttcattttctttctacttttataacaaacataccaaaaaaaagtatgcacaagaaaagaaaaacaatcacaatattaattcatgcattaaatgttaatttatagtgttaaaacaaacacaaaggctatggctgttgttcacggcttacgttgtcccaatgttaggtggtctatatgattggccaagtcgtgtcaatgtcatgtttcatgatcgaccgacataacattttaattaagatatttaataatgcaatatgttcgtaaaaatagagtttaatttatacttaatagtgtttgattaccatccgcccaaaacaaaaacaaaaaacatgtacactaattatgtattatgctacacattgtcaataaaattttaaatgattttgccaaaaaagaagttataaataacttatagttgttaatagagggaggaaaaatgtcttccaattaaatcttcaattctctgtggccaaccaatttcatgtcaataatagatcgacggtgcctacttttggacccatctctgtcttcgttatgccgtgcttatcaacactactctttcctcaaaattcaaacatcatgaaaagagaatctagaactgcaattaagaatttccttaaaaggtttacgatatatgggaccacacgttcctctgaatctccgtccatggcataatatggaccgtcatagatcaccatcacgtggttttatattcccatgatgctttgaacataacagcccttttgattaaactcaggtggtcccagttcaacaatcccatgcacgtcaaatcttagaaatagtgcatgcaacaatacgctttcttcattcacaccacttatgttcctcaggttcgctcgatttcaaagaaagagaatgaagaagtgaaataaataataaaatatgatcaaacctatatttttaggttatactttaattcaaaaaaattattttaattaattttttttctactttacggaacagactcttaatgttctagctaggaatatatatcatggtttttataagttcatatccaaacgaaaatcagctaaataatcaacacgaatggaccaatagaataatgatgtcgctcctttcgttttcggttgagaaagtaacaaagatagtctatgaattttgttaaacgacaatgttgataattgatatgtaattatgtactaccacggactttcattgctgttcagtcaaatggaatgttaattcttaaatctgatagccattatttgattttgtgtttcttatggctccatttccgcgaattcatgatatcgatcggtccctagctaccatgagctaccatttttcaacttcctcattaaactacttcagttccatgaatatttcatttaatttgtactgtcgtgaataaattgcagaaccattaatattacaattaattgctagctagtaaaaatttgaaaatcatgttatgaaggtttggacataaaataaaagttgtaaatcatgctatattttcaagttcacactcctgaaaataattttgcaaaacttaaaataaatatataaaaacttttcttatcttttcaattttacatcaactaattaatcacaattttacaagaaaaattatgccgagtatactgacatcggtgagacagcatttctttaaatatttttttaaaccaaactatgcaatactatattctttcgagtttctaattaaatctatagtcatctacatgaggtttctacagtttcaatttcagggatatacacattaagttttgcaaaggaattatcctcatctaaaattttgttttcttatccaaaagattaagagccgtatccaacttctcattaattggaatttaatataatcaattaatatgcttaaattggttattaagtaatcttcttatttattgaaaggacttcggggtagaaattttattttcctatttatgagaaatttgttatcttaacttctaatttatcaaggaaaataaccattcaaaattcgatcaaaatgtaaaaaaatataattaataattatttttgttaaaaatcaaagtcaagtactattcaaataattcaaccttaattttaacacattaatcatttatgtcaaattatttcataaaaatttatttatgagaaatttacttctttagaatgaatatatatatatatatatatatatatatatcaacacaattatccctttgatgtacatatttcttatttataaattatcctttaatatatttaactgtttttattttttcataaatgtaactgctacaatttctcctaaaaaaaccattactactactttttttaactacttttttttgttttttcttttttttaaataaagatagaggcacagtgcttcttattcaactaataaacaataaaagaaaaacaacttaaaaagtgacgatttacaaaaaaaaaattgaaggaatttacaatattttataaagtagtactttaatcagtgtattatacatgatatataattttgatataattaaaaattatataatgaagagataattttaatatataaaaattaataaataaatatctttaaatatataaattatattttcatttataatataccatttaaattttcatataagattatttataactatggacaatttttaaaatattaatatatttaatttagagaatagagatgatgataaaagagaataaattgaaagtaaaggactactaagaaggtcatgtatagagtagtttaatatggggtagagaataatttttaactaatcatcagagtaatatgaaatgtatgtccaaataaaagaaaaatgaaattattaaaaatatttaattaaaagaatgaaaatgttactctttaaattaaagatttagtttataatgtaggcatagattttagatgaatatttatggcaagattgagtacatccagcggaggatttgtttagtgaaaacaaaaaaatagttaataattaatttttcaaaaaatattataattttttacaaaatacataatctcgtgacaaaagaatttaaaatgcctctcaagaactattttctacacttaacaatgtattatttttattttttttttgttataactttttaccttcattttaaaaacaattgtcttatgtttctttatgggagcaaattattttttaattaaagatgtttaagtaaaataaaagttgttttggggggaaattgtccccgtacaaccctaagtgcatctatttatcactaaatatatcaagaaaatataatttaattgatacataatatatgaattattataaatataatacataatttttattcttacgtataggaaaaatattgtaaaattgaataaataatcacaggataaagtcatttcatacctattgccatcttctctgacatatagcgtgtgaatgttagaatggaaaatgggtaacatgtggtctgagatctaacataaatgggtcatcataaacaattaatgttttgactataatacatgtacttcggcattgcatagatttctagcatcgctttcaatccagcaatgttaattaacttttaattcaaggcccttagtttagggaacgtaaagagggataactccacaagctatggttccatatatattagagtagtttaccaaaacaatataaagtagtcgcgcatgtgtagtgatcctaaatgatattattaaaattgcactcttcactcttatcaagtatttttcacaccaactgatatggtattcaggaatgattaggtagagtattaggtccttatgaatagtttcaaactatccgcgtcttctatttttgtttggggtaagaaggtttcattttatgtaaattaagcttcttgttgactcgtgttttgatattcatggcaataaactatttttgtttatatcgatttaaaaccctaaacaagacaataacatcttgcaccgatatcaagcacgtcgttgatttgtgttctggaactttcttcagcttcaagaacactgcatgccaatgggggagttggtgttggtttgatcattcatctttgtttgttttatgttgcttgtttgtcttatgttcttttaaatacgaatgtgtatgcatctgttttttttttttcaattaattggttttacttttactaatacttgaccaataattaaaaaataaaatttacttttttttaataactaggcaggtatcatgtaaaaaaagtttttatgttatcaatccaacaaaaattatttttaatttaatttataaatatttatgattaaatggttgtgtaaattaaaaaactatactattaaataatacaatttatcattcattatataaaaaaaattaacagttaatattaataattaaatattccaaatttcaacttatataatttgttgtattgttagaattactgcattgaaatattgctttatactttatgaaccttgcggtgttgtctttaaaaagtgtttcaatgagttaagaaataaaatttatactttaatggtttcttttttcctgaaaatttatatggtaattgcctaaatagttaggtttcagcatctgggcatttataaaatgacaatgtaatggtgctggtatgatatctcagcttcctgtctctctgatgttctttttattctattttggtctgttccattatagacatcttaactcatcactttctccagttttgttttaactgaaataattcttaccactattctgtcttaaaattctcagttcagtgcattccacatataacagatcatttttttaaataataattctggtaataattagcagtgtactgatatcactttctgtgttgttgctgatataaccttgtttgatttataatcttggtgcagagtgctcataggaaaagattggatatcctcaacacagtggggatatcaaactctgttttgaggctaattgaaagacgtaacagctgtgatcaaatatccagggatgctattgaccatcattttcatatttgcttattttttgtggagacattaacacgatacgttgttcaaaaactgacatttccaaagttccaatgtggaaagtatataaatttagattttaggtttgtcaagctgactagcagggcaatttttccataataaaaatcttgacttgttacatgaagaaagatgctcatcaatctcatgtttatcgctgacgctctaaatattatatcatgatcaactcaaagcctgtaacagagatttcattcctcttttgattttataatataaaagatttcattaactattctacattctactcttcatattaaaacgttcacactagaatttacaaagattttactatgtggttgtacaagcgagggaactaatgtccagaatccatcatctcatctcactgcgcacacacctgaaagttgtggcacaaacgcatctgccgaccaagaaaaagacggcattgtttgcacaaggaacaaaaaggcaatcttctgactgaatttttcactgtcaggatttgttctctatataagctgaacgcaagtttcactttcactgttaggatttgtattctatataagcttctttcaaaactgaacatacaatcatcaaccttccgtttcgaccattatcgtgagaaagcaggatcaggtttggggttgatcccacttgttgaacttcctatgctttaaaataaggcccagaggtctggcgcccatcgtgatttaaaagctctgcaagggatccttttggtctcttaccaaaacgcctagtacctgttgctggcttgcctaaagttgttgcattgaccatactggttagtgtgtccacaccttctaacattgctggcacaccaatgcacccatcacaagacagaatacaagctatagcatgcacagatgccgccatgatgggaggaagtgtattccttggatgtgttacctaaaaatgtaaaccaatgtgtcataacaggaatgacatggataaatcacaaaagtgaaaagtacaagaaaaactaaacaagtaaaatttggttatttactttgtataaaatcgctgctgataatctctctctcaagcagtatatctgagcaacatcaattgctgttgaacgaaaataaagccaacggtccatgattactttaaccatactatcaggagaagacatcaacttatcctcacgacctccactggactcagcatcaaactccatcccatcttcacttccagcttcatcttcactacctcctgcatcatcctcatccccctcattattttcttctgctagggcaacagcaatctctgttgaaagcagcaaaagtggaagtggtccaacaactgtgcagttccttaggttcatacccccatcaccgcgagtaatctcatcatacacaattaaagtgttatctaaatttttcttgaatgacaacttaaaatttatggaatgattgtgcaggcgaactttatctccacttgttgtttcaacaataaccctatttccacttttatttgtaagaaatctcccaacccttggatacaaacctgctaccaaaactgcatggagcacaccagggtcatgtgtattcacactgtaacctgaaacgtcttcatgaataaacccaagtcgaattagttctgcttggagttgcctgcgcatgcctgataacatattcatggtgcttgaagacacaaaatactgagaacaaaaccgtgcttctagacccatattctttgcattattccagcattcaaatgcagccaatacggcaaactgatcactacaacccccatataaagaagcaagctcatatttggcagctgaagctctcttcttttcttcaggtaacattggaagtgtaaatggatctctataatcagatgcgcaggcaagagttaaagctggatcaaggcagttcatcaatatagcaaaaaaaagcatcctgcatattaatgggtgaacaggaagtgaaccaagcttctcccctagttgggtgagtttttcatcatttgaaaatgccccaatatcttgaagaactataattgcattgcgtatggactcaaaatctggaggatctaatgtcttgcgtagaaattcttctactttgcaacttggatcatgcaactttacctgtcacaagagagagagtaagaaccaaatctaacatgaggggaaaattattgtcttgtttcattatcatatagaatcagtccattgaaaccctgcttgtaatcccccacaaggacctttgctcttcccaaaacctgacaagaaagttgtttcctttgcacaaaccaataaccaaccacattacacagcatcgcacaaattagatcatgaaaaattataagtttgaatatagcattgcaaagttactaacttctgccattttctaacttttaatattgacactctaatgggataccagagaacctttttactattttaacactgagtatataaaaagcaccaagagtctgagtcaccaatcagggaagatcgaatacctgcagacaaagctcctcaataggcattctcctaatttccggaatctgaaaatctggcaaggaagctgctcgagttcttgaatatagatgatagcatattccaggttgacaacggccagcacgtccctctcgctgcttagcacttgcttttgaaatccaagatgactgaagagttgacacattgttataagcatcgtaacttttttccttcattcgtccggtgtctatgacatacactatatcatcaatggtgatggctgtttcagcaatattggttgatagtacaattttgcgacaaccatgaggtgggcgcctaaaaaccttcttttgttccatgcttggaaccattgaatgcagagatatgagcataaacattgaggaattcttgaaaaaagatgatgcaagcaatctctcacgtgttctatttatatcatcccagcctggaagaaaaacaaggatccctccatctgttgaatcaatacatatttttcttatcagctgctctatcaaaacatcatcaacaagttcagggttgactgttgccaggtatttatcaagtaacttcttctcttccatggagttggaaaaatcattatacatgtgcttcttcaatatttcggctgcttctggttggttttccctttcagtgatctccaatgcagtcattccatctttgtcccttaaacagcaatctgccccacaagataagagcatgcacatatcacccactctaccttttccagcaaacaccattaacggagtaagaccagttaaagaatgttggtaattaaatagttctggggttccttccgaagaaaccaattctaacagcaggtcccactgatcattagaccaagccaaactaatagcttcatcaatggaaagcttctcttcttctcttagctcacaagtgttttttggaatactaaatgtggtactatcaagatgattatcatgcctggattttacaatagaaagaacatcctccaaatagaaagttttgacctgaagaaaggttggatagacaattgtagtaagtaacatgtgacaaagtattggttaatttacaatctacgactatataggtaccggataagtgaagcccggaacacagatgattggacagcccccaaagtattgagaaaatctagcagcatcaatggtagcactcattaatatctgtaatattagagcaccagaaggttaaaaatgggaaataacataattataaattaaataagcacttaacaggagacagagaaatagagacaaaaagatataagtaataagtttgaactgaccagacgtaggtgaggatataaagggagcatgtctctgcatataaattaccaaaaattagagatattagtccaaaaaccagacaaacctcttatgccagtaatcttatgtataatctttcttctttgggagggaggattaaatataacaggaagttattgccacatacttgtggttaaaaaaaaggcatttgcactcatcaaggaacgactcaactctacccaaaaagctaataggtgcaaaatatctcgaacaagcttaacctacagcacaatgttctcctcacttatgcaacaagcacttatacatttgtatttaactataccacactatagagtaaaggccaataggttcctttcaatggtatacctgatgattgccaacatgaagtctgagtatcgatccctttcatgaatttcatcctgaacaaaaaatgaatgtcaccttagtttgcaatgcatagtttccgaggaaaggatgcacaggatatgcttcgtaatgccaaggcatactttccaaggaaagtatatgcaggaaatgcctcatatgccaagattcatgaagaggggatatatgaagacatttgaattcacttgtcacttaacacaacaaagtgtctaagataataatctatatgaaagtttcaaagtatacttcccctcaaagtattacaaatacctattgcaggagagacccgtctgaaaaccaattattattttctgttttcacagattcctatacaaacttttgaaaataggaaacaaagtaaaacaagtgccaattttgtaattaaaagtaaaaaacaaaaaatattttctgaaaccaaacagctcctaattttacaacaatttcaaaaaataatgtctcggattctaacagattttcctagtcaatttgaattttcaattaaccactttatctgagaacttaccagtcatacctaatataaccaattttttaaccatccaaataacacaaaaaaataaggtatagaagcagtatttaccaaatattaagtaccatagtttatgctctagctaaagataaaaaaataatttacaagtaccataattatgtgagtgatgccagaaatatcatccttcacacgccctatctttgacgaatgataacctttggaaacaagcgcccttaataccactccagtggtacatagcacaattgacgattgccttccacctctgctttctaaccgtatctggattttttgtttaaaatgtaagccacagaatcatatgttcatgagatgtaaaccactaggaaaactagcaatatgctactataagaagcaaggaaaccagtgcttaggaagggacttgcataatcaacataggatattgaatgttgaagggcaaaaagtcataattctatgtaagaaagaaagtgatatgggaaaatagaaaagatatttgtagattgaagcaatattactaatgatatattatagatttcctcctcggtatcaataaaaacatggtgtgttatgagagtgtaacacacgaatgcaaaaaactagtctgattatgataacaatgctcaatgttcaaataaatatttctatacaaaataaattcaaataaaggatcagagtaccattactacaccaaagatacataaacaaaattaccttatatcccacattttctccaatagtctctcctctctcactagcgattctctcggaaactaaacataaaaacggaagaaggaaacaaattgacattaaaactaaaaaaggaacattgaaagaaacacatttcaattaagactaaaaaaggaacattgaaattcaagtccgaaagagttacacacctgaagttgcagagatccgccgaggctgagtgcaaagtattttacatacctctcccttaccccacatatgatccaaaataaattgtgggacctgaatcatgtttaatataaagttaaacaggacaattaaaaaaaagagaaagataaatgttttgcagcatagaaagattactaaaagaccttggtccatatacaatgatgaaaatacagatgggtgaaacccaaaatcacaaagcatcaaaaaattatcagtgtccacaatcatcaaagcttgagtcaattattttatattaagggtaaaaagagcaagtgcattaatacaaaaattaaatacgggtgcagagtcatatcacaagcatacatactaaatggaccaattataaaaatatcaacatacaacctaataatgatcatcttgaaacagtcacaaacaaattatatgtaaatgtagctgcaccataataaagacaaaacaaagaattcgtaacctgcgtagtctttccacaaccagtctcaccagatatgagaacaacctgctttgaaacacgtgaaagaaatattaagaccaaaacacatgcaaaaatttaatctgcaaattcaatttaattgtcatgttgaaatgcactaaaactaaaatcttactcaaccatgttatttgatatatttagcatatcaatgtgaatcatataagctaaattatagtgcatgtgcaaccatcagcacccaagctaccaagtagatgcatatccaaagtcaattttaaattaacctggtgagattcaacagttgatgtaattgaatccttgaaagacgcaattggaagcttagatctcccttcaatgatctgcgagaatggaaatcagacaaataattcaataacaagactattcttttgcaaattctatatatatggcagaagaggaataataagaaaacatcattctgatatatagcaggattaacaaattgctttcattctttgcacagacaaatgatttgccatacacacagcaaacaagcactacatgtcgctatacatgattgataactatggatcttcatgagaaacatttatagagaatgaatgaaattctatagtatttgaagaatagttcaagagtggcctattaatcatacaagtgggaaagttgtccatggaggtgtgcacaaatgcagattacgtaggatccactattgataaaaaaaggtccacctcatggtattgcatgttcttgaatggtagtttggtcacatggagaagcaaaaaaagaaaaatatagttgcaaggttgagtgcaggggcaaaattctgatccatggacaaagggtttgtgagttatcatggttgaaattgtacttgatgaactccaaataaaatatgtaactccaacattttgtgacaataaatcagccattaggatgggacacaacctaatttgttcgtctatatatatatactagccattgcaccattttattgctagtgaaataatattcagttcccttattttgaagcaaacactaagcaacaaaattcatatatgtaggttcaccaacaaaactcatacatgtctggagttgaaaggagagagaaagaaggaggacctgtttcaagttagagacattgttcattctagaagcaagagcttccaatctcctagcaatttcagctttggacatagagggccggctgaaaatatcatccggcctctgttttgttccctcagtagtagtgtcgtcactattttctccgatcatctcccacgagtttccatcaccgggtggataatgagcaaacaaatcacccaacacccactttgcctctccagaaaatgtgaaaggaggaagacttccaaacccgttatccgtgtcaaccttctttttcattttttcaacacacactctcctttccttccctggcctacacaaaacacaggtccaatatgaacaataacacaaatctaaagcattcattccatctccaactattccatttaagaattttgacaataataattcttacagatttaactaaaagtggcaaatttacatgcgctgcccttaacactcacccataacttctagatctaaaccccattctgagggccatttgatgcacccaagcacgctcttggttggacaaaccaggatcaaacttgtacactgcagcaaataaataaataaataatcaaaacccagatttcatgaatggatatagttatgcaaaaatcataatacgtccgacgagaaagttgtgttttttgtgcatgaaatggtgaagaaaaaagggggggaaaaataccttcatcattggaagctcggaagtgttctagaatctgggaaatgcgaatcctggtgacttcatcaactttggggttttgacggaaaagtggttctcctttcttcttccctatgttgttcgtcttcgtcgtcgtttccattgaacaaatccccagtgggtaacttgatgcaacaagcgcagctgcagctactgctattctacttttgtctttgctctgttaaatgttaaatttttaaaccttatacacttatattattataaggctttgcatttcaaccaggttcgggtgaatgaaataagattatcgaaaataaattatctccttagattaatattaatatttaatttagcaatcaacaaattattaatttaagtaatattagattctgatttttttaataagttctcgattcgaattttaattagaatggaagaactccatcaagttaatttctttgatgaaaattaataattggcaaaattctcgatattacttgacaatatgattataaaaaaatcaccagggatcaatatttaactttggaagaaaaacactaaaaaccttccgtcatccaaacaaaaagttatgccctagctagtacttgtgctttccttccgtcatcgtgtatatcgtatctttctccgctgttccattttatctgtttttgttttccatattaggtaaatgcctttttttttctttttgaaagctaggtaaatgccttcttgtttatatgtatttataaataaaaaatgtgtatttgttcttttagcaactattttaattttttttattggaataaacgagttaagtgtttgaaagacactgctcatttactaaatatctgatattaaaataaaataattagttgttaactttcatacatgtcaagtggttatttttcatttttaaatttttctcttttcgccttaattttaattttttagtattagtacttttatattttcacttaaagtaagaaaaaaaaatcctatagtatcttagatgtttgttatttttaatttaaatacacggattcttattagcatctgttttgcttctgcttttccttagtgtaattttctttttgttgtttcttttccttcgtttaccaaaaaaaattgttatgacatgttcatggaaagctataaccatccctagttcattcaaatgcacaaaaatctttcaaactttctctgatgaggggttaatgttttttttttattaatcctttgttcactaagaaaagaaaagaaaaagaaatattgactaattcaaaatttgatccaacgataactaaaatttgatcaatagttattttcatcaagaattgaacttaaatattacttaaataattcaatcttaactttagtatatcaatcatttatgtttaatcacttgattaggagtccaataattttaatcctttcgtgtttacatgtatccttacatttaattctctaacttttctaaaatagactcttatgtaaagtgtaaacataagaggatatctatctatttttaaattaaaacaaataattaattaatattttaagaacgctagataaaaaattaagactataatttttttattggacaacataaaattgcgctcttcataattttgttgtgttttcctatcatttttacattaaaaacttttttattccttaattattagaacactggttaacaaaacttttaaattaattatatttataatttattttattttaaatcaataatagacgtgtgttttttcatgtcgcatttttttttaatgagagtcaatcgtatttgaataataaattattttactttttcacttcacatgctcatatttgaataataaaattgcttttactttttcccttcatatgctcattttaaactagttaaatatattttcgagcacgaccctaatagttacattagataaaaacatttactcttaactttttactttttgtctaatagaacaccgcaaatctaaaacttatgtcaagtttcaagtaattgaaattaatttgggtggatttgtttaagaaaataaaaatctttcaacatttctttttcatttataatgaatcaaacttaatcattataataatttgtattttcaattattacgagaaatgagagtatgagaataaaatcctaactctaatattaacaatggccaatttgaggctaggtatttactatacaaccccaaacgcaaatttgaatctcgggaaacagagaacccaaactcaatcataaggagttctttctgtcaaaaacaattgagttgaatttatccaccatccaatgtctagaaatcctcaccaaggtattctagcaaaccctcgtatggcagtgatacttgttaaaacaagacagtctcccatcgcagtttgacattaatggaacacggatttattatgagatatatatgaaaagtcacatgcatgtttgacatgaatggtccacttgtgataatagtaatcgtatttacacaattgcaatgataagaaaaaagagaaatcaattggaatgagtttgtcatactaagttcccccattgcagtaatggatgccattgctgtgaacattttggtacttgttgtgcagacaattcaggccccataccctaattgttcggtcatcactggctgaggctaacatgtggggattttctggattccagctcacacaattaacagatcctgaatgaccagccaatgcttctattagctcccctgagcttctgtgccatatgtaaacctacaaagataccgaatgcaagtttaataactctccaaaattatccaatagaatccactatcacaagaagtttggttaataatgccaataacatttcaggggtcctacatgctgtattgtttcatatccaaaagaaagaagcttagcggctgctaaatttctatcaatctaagatatatcttgtatctatattcctcatggaaaatctactaaacaccacaactagaaactagtaaatgtggattttcttttgtgttataatgacaaactgatggccaagaagaatacaaaagggaaccccaacagatttaaatacagagcatatcaagcagaattccaacattatcaatcaagatgctcctagttttatcaagataaattagaataaataatacagaagccaagataaattagaataaataatacagaagccattataatagttgtagttgaattcattcaactaatatttataaagatatccagtttatcaatcagagcacaaagcaccatttcatgtgtcttttatgccaatattttaatgaccctcgatagatagcctgcatcaagtgcatgttgaacttattttgaagaaaaagtaacttatttttacaaattattgagacagcttttaaaaaataaaaacatttaacagagagatacaaacatcaaggctttcaatttgcaaattataaaaattacacttgatgaatattttcccattttgttcaatgatgattgaagactcatacctgtgaatcctcacttccactagcaatgaaagcttgcttcaggccaccaaagcaagacctgataataaaccgggcgcgtttatgacctttgtacttgccaacaagcttaggatcaccttcaatgttccatagatgaatttcttggttcaaaagattaaccaacaagaatttgttatcatttgataaagaaaacgaggttattgtttcatactcttcaataaatctctcatcctttgtttctctattgaacaacagtaccacattggctttacaaatacttagaatctcttccccgtcatctgttatttccaaatcagatatcttaagggttttttgtcctttccaagactccacgtctttcccatctaattcccacatgcaaatgctcttgtcacttaagccacaaagtatatatttcccacatggaaaccatgaacaggagactagaccagcaccaggtttttcataaatttggaggcatttgccagtagagacatcccaacgcctaatagcctcctccactccacatgtgaggagctcttggtcattaggactccatgaaacagaagaaacaggcttctggtgaccagataatctatgctttacagacagccttccatttatgccaacctatttaaacaaaatttaaaaagtgagacctaatttcatagcattaagccatattttattagtgtgtgtgtgtgtgtgttagagtgcaattcttgtgtcttgatcaattgggtgggtgggtatcagaagtaaaacattacaactaggatatggattggcaatatgatgacagaatcaaaacacaagcaatgaaaccacatttatcagttcatataaaaaatatgaaagagaacagaaaagacaaaatgtaaattctcagatcagtatcaaatattacctcccaaattattgcagttcgatcttttgatgctgaagctaaatatttcccattatgcgaaaattgtacaaaccagacttcatcatcatgtgcttctaatatctgttgcaatattaatcagaaaataacatcagaatatagatatgactcatgctatagaaagcaaagacagggtggtcgttgtaaagaaatagcaaaagaatggatcaacggaactgaagacaaattctttaccttttctcatttcccctcccttgaatccaactaatgatacataaatctcatttacaagaaagtgcattttaacaataaccacatgatattcacatccatttccaagatgccacagtttagcattcgcaaatctagtaaaaataactttataatcataatcaagaaaaagtaaatgcaaaagaaaagctaacgaacagagttctagtctgcaataggcaaacagaaaggaggaagctgcttccactaccactactaattaacaagtcaacaatatctattagacacatcatttctaacctgtaatgtactggaaggtatctgatcttttccacaatgatgatctgaatataatgacatctccttatccaatgaattatgaaatgggcatgcctctcgttgcaagataagggcttgttcaactagatgctccaacctcttttcaggtatcattactgtggggggaagcagtttctgcaattcctccagaagctttgatcgagacctcatccttagaatatctagcctaggagatggtgaaactaagcaggaagaaagttctcgaattctactactattaatgcaaagtggagcaatctctgtccttaaggtcttcaacgcttccatgaccttttcaccatttagaagctcaaaaaatttctgctccaatattaagaatgaggctgacctgaccatactttcatctgccagaccaattttatacaatgtggctacactgtcatcccaatttccatcaagaatttgttgcataaacagatttaccccaggtgagtgtaaaggtattccagactcctcctctagatgtgccccactctttccgtaaccaagcgagtataatgcctttacaattatcctgacaaattcctctttctttataacccctttggaaccaacaacatgttcttccccttcggatggtaggggccgagccatcaagtcactggacaagcctccaacaggctctttagaagaaccgttagacaagccaactaatcctttagaggataatttcattcgtttcatggatggttcttcatcttccacacctcccatgaaaagtgcccccttagcccatatataatttcagaagcgagaaaacaacacaaacaaccatacaactaagaaaatgcctctgaaaaaccacaagggaaaaaaatgtctgcatagaaaaacacaaacaacaacagtaagtacaataaaaccaagacctgagaacagaatctaaaacagcaaacaaattcctcaaattgaatcaacaaattaacataagcttagaaaatgtcagtggagaaaataaaactctgtatagaaactaacacaaacttaattagcataacaaataacacaacaaacaaatagaaacaacaaattaaaaaaaaaatgtatgcatagaaaacagaaacagcaacagtaagtacaatgaaactgagtcctgacaaaacagaagctaaaacagcaaacagattcctcaaattgaaacaacaacaacaacaacaacaacaacagcaataaaaataataacaataatgcaagatgcaagaatccaggcttagttacttgaaagcacaatgtttctaccaaatttataatcatctatcgaaacaattgagattgcgtgacgcctagcagataaaattgcaaaataaataaataaataataataaacaaattatatatgcattttccgaggaaacaaacagagaaaattggaagagtaacagaaataagataagatagaacaatcggaatcagaagtggcagatccaataagtggagaagaagataaagacggcgatgatccatccaccgacttaccgaacaagcaaagcaacgatcgtaaccaacctttgagatgcgatcgtcagtttaacaccgccgattccttcttcttccttcttcttctgcttccacacactcttcagttaccaaccaaaaccacatacgctctaaaatcccaaaccttctccttttctgcttgtgctgcaaagaatgataacatatatacgtaaaatataatataatacttttttttttaattataactatgaatatttgtattcattttggttttttttttttttttactataatgaatatggttatgacttgtatgataatcatcacaaatatcatatcaatcatgatttattattagataataatatataatcattttatattatgtgtatacgagttcaagtgaatgaagaagaaaaaaattggttagcggaatataattagccaaatttatcctacaaaaatgaataacttataaaattggcaaataattggcaccaatacattttagttttacacccaaattctactggatttctttcttttttctttttctagtcttctcttttatagctttcccttgtgtctggtgaatcactacccttagctagatacactttcgtttggtttggtaattggtatacgccttttccttccttgtttcttaaaccatcacgcgtttcccttctcggttctcttttcacacgcaaataacttcatttcaatattataataagagtaaaggattatacactctcagccttaaaaaatttaaattttgaagatataatttgaatttaaattatattttttaaatagaaatagattgttaaaatagtttaaataagaagaagtttaaattattattttctaatattagatgaataagtgaatgaagagataatgaatttgaaattattattttaatttatgtgtatatgatttttaacactaatatttaatcataatttattatatataatataatttttttttataataattgttttaaaaaaattgttaacaataaaaatagtttattaatgatcattaaactttattatcataatctaatcttcttgctgtgtataaacaatgagaaaacttagctggaaatgggataattaaggcacggttagtcgtacatgtatgtatctatattcaggaaggaatgagtatcgtggacattttaaatcattgagtagtgtcgtgtcagatatttctactcactccaaataactagttataataaaaataaatattctaaagattactaatttatattcacttatttttttaaaaactattttaatctataatatagtatataactctacaataacaatattaatcagcataacctcaatagttttttgactcattttacctcaatagttgctgataatttacaagaaaaataacaactgcgcagataggttagatgcaatacaaacagtaagtaagttgggattcattagccaatgaaattgatttctttacagcacacatttcatgaaattgatttatataacttttataagggaaaaatatatcagattaaataagtcagtaggtctcaagcatacatttcatagatttgatctaatccgtcaaattaggccaaattggctcaattctcttcagactaaatttaagaacccgacccagccttatttataggctgtttagattgggcccattttgtcacatctatgcacctcttaaatttcactcgtattatatttaaaattttggataactttctcaactctgttgttcctttatttaaattccttacactccagtgtgatcattaataagggatctagattttttgtgtgtctagatttattctactaacaattgttatatttagatatatttaatatttttcggtaaacaattttttaaaattttattaagatcacttgttatacatgtactttttttaatagtacgaatcaaagacaatatgaaaattttataataacttatgcatcatttacctgttgaaccaaatgaattggatcctatatatatttactttaattatagaatataaatatttttcactttttatgataaataagtacaatcataaaaatttatgtattagatttaaactatcttgcacctctcatctccgattttgtggggataaattatttccactttcttgaggataataataatttaaaacactattatttcttctattgtgaagataataaactattgttcctctatttaaaaatttctcactttatagttaactggaatcacaataattgaaattagtaacccgaattgttattgaattttaattattttaattgattatatttagatatatttaatattcttctgtaaaacaaatttattaaattttatggacatcattgatatatattcacttctttttattttctggataagagactacaacttttatggtttacaggctacgtttagctattgccttgtctcgaaactggctcagtggctcccaataatcaaaccattagaccatgccatagacagactaatgatcaaacctggttcctattaatcatgatattggaatgatcaaaacacaatgcagttcattggtacgtatttgagtttcaccttagtaatctacattgatctttaatttaatgcagattactaatgtaaaactccaattctgaatgaaaaacagcatctacaacccttaagaaactgcgctaagttttgtccttataaattatcaatttctgttttgtcctatgcagtcctgggttagaagactccattaattgttctttcatgcttatttcttttctttggtctctttcaattaactacgtttcaaaatcaacatttcacactttttaatttccttgagataattgtttctcgaataaaaatttaagccttgttacgaaaatgcatactccttgtagcagcttaacgaaggagacattaagtattcagatacttaatccaaccaagtcccttaaaattatgaaacccgtggaaaaagggaggttagacaacttcaaaccatagatagcacttaaaggttgatttacacatagcatatatatatatataaaatgctattgaagttttttaagcaacactgaaagaacttgctgcactctccacaaatcttcttgctcccttaaaccacctcttgtctccagcttgagccttgcaaatgaacagttttccatcttttacagttgctctaattatgtggtgcttgccaccttcatctccatcagcagtccttgtcaacacagacagaaaatagtatggcttcccgtcaatcacaggtgttgcagtctctaagatgttagccgtggccactgcatttggatcaaaaccaccctgtgcaattcaagttcagacttcagttagggcatgcaatgatgatatttggcgcattcattcgtgtttgatcatcaatcacttacctcagcttgtgtttcgccgaagaaggcctgttttcctagtaaataatccacctgtaacgaggaaacaccaaatcttgaatttcagccagaaagtagaaactggtgtcacaatcttcaaaaattcatatattaccatttttatttttgaatgtatactaaaaaagttaaaattagtaagggaatgatctatatgcaattgaagaaaaaaaattgtcactaattaaaacttagtggtgccagaattagtgagataaacaatttttctttactaaatttggtcactatttcagtgattttgttggtacttagaaacaaaaaaactgtacattaatggggctatatataagtgttccttattaattagaaaacaaacagaagtactagtttaaaacaggtttaccttagagaggaactcttcgggtgaaccatagtcagtgatggacttcttatcagttggagtgatggtgacaaccacgttggtggttgagtcaaagttatcctcatatctaacaacctgacccgtgtactcaacttctttgcttgggttccactttgagggaacagatagtttgaatccatttccattgtatggcaggaaatccgtgtctgtctttggctttccaaacacattggctgcaagtaaaacaaccaagttgctcaaataaatcatgtcatccccattattattagagggatcaactcccacctaacaacttatacatttgagataagctgatccttgacaccctattcgggactttatgaccaaatggttattttagagtctaataatctttgccaactccattctttcaattataatttctgcacaaggtttgagcgaccttatttttcaaaatagtctaagcatctgaattgatttcgttatcgacttccaccatcaagacctatgtaaattcctacccttggattgtatcctataatcactatattctttagcttagaccacaggtatctacggcagaaggaaggcaatcttgctcgattcgagtaagactattatcggcagtaaagcattcctttggcgtattcaactcaactgcacacctagacctcgaactttagatcactgattaagctggagaaaccccttactaattgatccatgtgattggtggtttatgatcactcaatttatttcatcttaaactctaccaagtaataaagagtagacaattcacaaaaatcactaaatcaaaagtagattatagtaacactttagttactatgcatgctagaaatcagttcaaagcaatttgcagctagccatttgggtggtcaacgatttttcatggcaccaaaaaataacatatttttcctgaagcatggcatgatctttgcaagcagtggacagtataaaaaaataataatcatgcaaatgagtatttcatcttcaaaagccaaagactaatgagctgttatcatcatttgagtttaatattgcatgatcataaaaagagagacaatgaaataccagcttcaccataggctgcatcagcaggttggactttggagccaacagcagcagcaccaatgagcacagttagagctaaccggcgagagattgggctgacatcaatatcttcttgtggtgtttgctgtttatgtgccttgcaaacaagctggttaggcttggtgctaaccatgatgcgttgtgatggggatctggcactggcaggggtggtaagagcatggtggtgcaagaaacattgtgtagaagccattcttctctgtgtctgtgatctctttctctcgttcactttcctcagactatggtaggaacttgttggagtttagtttcaatgtgttatgtggcaacgaggattttggatattggattttggaagaggatgattgggaaaattggattagattgtcgatgtgggataaggtaatagaaactctcattggtgccacgtcgtatcacgtattctcatttgcctcatgccatacccattttgggacaagacactgtcatattcattactttttgttatatatatgatcttgtattcgttcaagtacttgtttttaatatttttgttcaggtaattaaagactaacttccaaaacaaaatagaccaacttccaatcgctttgtgttttagatattaggtcgaagagcatagctacagtttctaatagtatatttttttcaattccacgttctattatttgttttaaagttattaaaaactataaagcaaattatacggattctcctattcttgctcttattacgctcaatatcatttcattttttttttatatattactttgagttcctccaaagaggatcgacttaacgatttacgcctgagagaggaggtttatataacgaaaactaaaaaaattaaaggattttatgtgaaaataaatggatatcaggttaggtacgtataataaggataagtctcaagaggaatatgtgtaatttattctaaattataaaatcccttattaaatcaaaagtaaaattcatcaaaatttattatttttcttaaatttcaattaataataaagaaggtcataaaaaagtgtattagagaatatattatcaatatttctctaagtttaattatctttttagttctaattttataaattttctttcttttgttctttcttatggatttgatctaattattttggatcattatcacattagagtgaaatacttaacaactttattgattaataatttttgcttggaattttagctagttattttagtaagatttctacttttaacgatcactttttttcacttataatgatcaaatcagatatattgtttaaagaaatcaaatttagtaccctcaagttaataatttattaattgattttaattattttaattgtgtaatattaatttcttcattaacttaaaatataaatatttaatgggcgtgttgacgtagtcataccatagaatatcgggctagtatgaatgtgccgctaggacggtgtaatataatgtcgcattaatattgttgttaaatatattagatattaagtttatagacaaaaaataaaacaattggaataataaaggaataatttgtggaaataaaaatcagaaattcagaatacaaaattaaaaatataatcaaacctaaattttaacaactataagatctaatacggccaaagactataaccatatagtgtggaaattgttaattagctcttcttcagttctgtaataaactcgatccttataatattttttgctttactcaagtagtcaattttttgcaataaatttcttttaatgtttagaatcatacatagtagcttatctggaacaatatttccagatcaagtgcattgttgtttacggcgtggctcggactccaaaaatcccaaatgggaaatgacggagcttcacgtgtgttttgttttcattttcagaacattgctcagttcctcaattatcactagttctttattcagatactacatttctatctttcttgttcgtttggtatttagtgtctttcaaatattagttaagaaaataataataaattattaatataaattataaaagaatataaaaaacataaaatagcattttttttttgtttttcaataaaaatataagtaacattttcttttttctttttgaaaactctcatttctatcattaaatcattactttaagaaataaaaaatcataaaataattaacataaaatctatttacagtaatataaaattaataataaaaaatagtccatacaataatgttattaattttttttcactattcgatctcaatcaattatatataatatttttttaaaaattatatcaataatatttttttaactgattcaaaatgttcaaaaatttgtattgaaaattcatagttaataaactcaatttaattcataactattattttatagtagtataagtttatttggacaaaattttctataaatatttttaggaaaaaaaaaatgaaacaagcaagcttgtgtcgcataaaaaaataattttaacttataaaagcatttatttatttttatttttctataaatatctatagtctgaaatttatccaactagcactattttttttattttttttaaaattcagcaaaaaaaaaactcctacttttattaatctataattatcaataaaaacattccatttatttactattcctaatttattctttaactatttttaaaaattactcacaaccacgagtaattattatctaatactccctaataattataagatctttttcagaaaattatttttattttttcatcatacattttttaatttttttagatgtattaatttttttacatattcttatttagttattctctctccaaatatcaataataaataattaagtgaatagagataagaaaaagatgattttaaaatgatagtataattatttgacatatttaatataattaatcaaattaatttttttaaagaacatgaattagttaaaaaaattataattaaaaatgaaaggaattactttttaacatgacagtcattataattatatttaactaaaaaacaaaaaaagacaaataaaacacatgacacagaatgcacaagacatggatggagtgtctaattttcaactagttaaaataaaagaaactaaactcttttcaaatactactttatttatattttatagtagtaacttttgcattttacactttctttctttctttctgccattcattataccaacgtataagcatctctttctctctctctctctctctctggtgtgactttgcagtagtcctttgttcgctacttcgcttctaccctcctctccattctctggtttgtgcacgaaaatcattcatttttctgttttaattgattaaattcatgcttctgcttcttcctttgatgctgcctcttttgcgtttctactggttttcgtttctctaatctgtcttgttgaattcactgaaaatttctccagttagggatttgcacttgtgcttaaactttgaatttcttcgtatattcgtcatatccctcattatatgtcaaatgctcgtctttcatgcccttctcaattgggttgaaaaaaacttgcggtacccctttttctttactgctttcccagtttatgctttttaattaagaaaagaaagtaaaaaagaaataagagggaaaaaaaagctaaattcattttgtcttcaatatttcaaataattctctctttggtcgcttttttctgcccaaccaaatacagtaaattgaggtgttagtctgtgttttgtgtcacaatcactcagagtttcattataacatactttatgttgtgcactgattcaccgtgctctccattttccttttgcatacaaatcctttaaatttcaacaaatacaatgtcaaaaacttaatcagccccatattcaggccttggaatgactatgacagtaatggaaaaggcataaaaataataattaaagttatcaagaatgctaaatagttcactgtagacactatgaagttaagacccaatttgcagcaataacaatctaaaacaacagacactaaatagacttaatggggttgaagtagtaaacttgatgtagcttaagccttaaatacagataggctaagttaataattaattgccagagatgtttctttttgtgaccatagaccaattagacttatttcattttagacgagataactttttgcctttgtgaaagtatgacttgatgtcggtagtatgttcttctcttttgttaatggttcgggaaaaagaaaattgtatctttatattcatttcgtgtgtgctggtttcttataaatggtgattgatgctgcagtggtgataggcatgatcgctattttcatggaatgttttgtgatgttcttttttgttcgtatagaagtgcaggaacaatgtctgagaaaatcacagctgaaaaccttttaaacacccttgtggaaacacttactgagaagcaaaaatctggatcattttttgaagacaagtcaagctcagtgagctcccaattcaatagactatttggaagccagaaacctgtgcaccatattttagggggtggaaaatgtatggtagttctagatacttaactgtaaaatctatcatgttggccttgacttctaaactttttttttgggtttccattgaatgatgcagctgctgatgtcttgttatggaggaacaagaagatctctgctagcgttttatccgcagcaacagctatatgggtgctttttgaatggcttaattataatttcctaactattttattctttgttgtggctcttggtatgcttggacagtttatttggacaaatgcttccagcttgtttagcaggttatccaagcatcttctcttcttttgatgtcttactttatgtaaatatattatgctactttacagcttaaacatgctttgttctctgttgggtgacaggaagccatctaaagttccccgttttgtcctcccagatgatatctttgtgaatattgcaactgcagttggtgctgaggttaaccgtggtttgaggtttctccaagatgtttcatgtggaggaaacctaaaacaatttgttattgtatgtttacttttatgtttgctttcattgtaattgttatttacgatccacgttcatgcttagaaaatagaaattagaatgtagtttccaggttaaaccattcttcagtttctgacaccagtatttgctatagtacgtgttattcaatcaattccatttatttttgtttgctacaacatcttctgtttgtgacatgttattgacatatctcatcaaaattgtcaattgctttttctcttcttcgaatttctattttgtactcatgtagaaagggataagtttcttgagttcgtgggaacttgccaagtcaactaaaccttatgtgacattatcttctaagagtcatttgatcttaatttgtttgttattgtgtggtttcctgatttgattactttgttgttgccaaagatttgaattactgagcaaaaaacacaaggagttggcacccaggaagggtgtgggtaggtagggggtgggggagactgcatccagccggaggtatgatagaattgaattggggaaacaaggattttaaattataagcttcaagggtcaatataggttgttttacatgacttggagtagtattatatcacaaagaatcaatgttggtgggttgtatttagtatctttaaatgcacaaccatgatgatgcactttctactttgccatcagttattttataacttgtttttatgttatatatgatagattatatttacttttatattttgttgcaaagggaaaatatatgctttttttgtggaatttgtgataatggctataacatccccaggttgtagtaagcttatgggctggtgctgtgattgggagttggtgcaattttttgactgtcatgtatattggtgagagacctgctttcttttcatctgttgatatagattagaatgtgttgaccagagtgtctgcttgaactattaagtcagacaaagtttgaaaaatataattcaaaatttcaactaatcctacaaatatttgctcagagaaatgtgaattattgaaattatggaaattgtattatattagcatttggtaaagccaaccttatgttgtgcttgtatgatggatatgaaggatgattaaaacgacatattaactttcaaaagcttgttatttgtctgtctatgccataattgtgtagcataggaaacgatttgaaagatgttaaattcctgttaagatgctggagtcaggagtttggatggtgtaacacaatacactcacacaaatgtatgccttgttaagtgttttctgataatatgctcttcaattaccaaatcttatttgaaatcaaatattagtgtatgttgatgtatattattttgtgggatagtggatctttttcttcttgaagttcgaatggatgatatggtacctgttagaagttcaacgatgatgtttttccttctagtttgacttttcaggtcatacctgatttgctaaaatttctattatgttatgtctaaggttttgttgctgcacatacactcccagttctctatgaaaggtatcaggatcaagttgacaactttgtgtacaaggtctttgatcagatgcaaaatcactatcagaagctggatactggtttgctcagcaaaatccccaagggaaagctcaaaggaaagaagtatgaatagattcttccttatgtaaatggtttgattttcaatatccctttctctcacttgtgatggaactgggaaaggctgaaggatgtaatgtaaatagggaaaaattctatgttgggatctttagaatttcttgtgtctcattatttgactggggatcaagacttcattaatgactgttccaaacttgtgaagccacttacaaggcgtttgatactaccccagtttaaaacctaatacataaaaaagagtaatgtagggaatgggaggagaggagagatattttaagaaagggaaagtattttatttgagtcacaaggggtccgggaaataaacaaaacgactattattcgtttaaaaagatcaaataaagctattaaggataattcagtttttttattattaattagtgtaaaagtttttctccgccaaatcccgtttaattttggagaaaacccaaaactgtctttttattttagtttgtatacttttgattatgatttaaaaaaaaatggtatattgtttttaagttgtttttctgatttcaagaatttataaaggtagtgaaacaagtttttttttgtatattctgaaattaaaaactaaagtaaaattaatgttatttttgtaatcatttataaaataatatagatgaaatgaatagcaaactaaaacctaccttaatagttctcatttgtcaatctggccatgctatttttaattttctcaattgaatccttgattagttataatataatgaaacttgaacaggatcattgagttgattatgacactggcttatagcccaattgatcgagcatacttgtatatgtccacttcattttaaaggttctgttattttgaattcgcccacacaagctcatcatcctccggattacttaacttgtaaattaactttattttttgaagaacttatctatacttatataaattaaaactactaacaaattaatcatttattaattgttttaatgtttatttcaaataaaaaacaaatacaaattagatattttttttccaaatctttacatcctaatataccttaatataatatttaatcatatatctatatttttatatttataatatttatcatttactcctatgtcataaaataaattataacacataacttgctcacataatataaaattataaatacatgaaaataatagaaataattatagttttctgattttcatttttaaataatggcatactcttctcaatttcaattataaattattttaatattaaatttaatttatgttaagttaatttaaaaatataaaatattatttaatatttatcatttacataatttgaaatattttatggttttattattattattattatccaaatcggttcaatttcaagtcttcttaatatatactcatttaaatacaaattacttgtattgttagaaatgaatctagcttagtcaagttagattcagatccacttgataagaaatgactcgatttaaagtcaaatttgagtttaatgtaaacctttatttttctacgatacatttcactttaaatgacacttaataagaaaaagataaatataaatactctctttggattcatatataagtaaaaataattaatttaatactaattaagaaatttagttgatattatttaattttactaatgtcaagtaaaaaaaaataagattatttctaaaatatccttaattgaaacttgttatcatgaataaaaaaatagtgattaaaaataaaaataaaaataaataaaaagtattttagaatgataatattaaaaagagcaaaattaattaaatttatttaaatctaacatataagatcacttttgagatatgatatatgtaaaacaatttatacaatatcattttatgtatctatctttctttaccatatcatttattatatttcaaaattttgtctctcctctcacttttcttcatttctatttctttgttttaagatttgttgtacatgtaaaaaattaataaatgttaacaatgtatttagaggaaagaaatgtccactactattcataaaaaataaaattaaaatatatgtacctaacccagtcgcttcaagccacaaatgtgtgatatatttgagtagtcacgagggagaaatgaatgatgaagcacacgtgtttgaaaagccccttttcctctcaaatgatcatgtttggccaaaacctatgttgtaaaggtttttaccctttggcgtttacattcaccttttctttcgtgagctagctgtttttggcatatccatgtcatccaagtgcatgtgacggtgaagctcaagcgtgtgtgcagcacttaactccacatgttaaatgcatttagcaacatgaagccatgagcttgcctcaagttttgtccaccatggaaatttgtatggtcagaagcttcaccacctcagccattgcctcctttgcactcataaaaaacgttgaattctaacaagaaaacaaaatcaaaagtgcctcgttggtagtagagaaagaacaaagaaggcaaacttatctttcagcaaatctccaagagaaatgctattctcacacaatttttttcaggaatttaagagagaaacaaagaaaaatacaaaagtataaaacaatacaaaaacaattagcagacaccctttagttgaaagaaagaaaaatgagagaaacatatatatatatatatatatatatatatatatatataaccgttaatatgacgtaataggaagagagataaataaaatgaacaatggaatgaaaagagataagaaaataaataaattataaaaagtgttattatgtgttgtaaagggtagaatgatccaatttggatttcgcaatatattaaaagctagccaccctatattttatcttttcttttcttttattttaaaaatacaaatttctaatgtatatataaatgtaacctaggtcacaaccgaggcagtctttaattttatagtataactcattctgtcatatatctgtgtaacaatggtggtctctatttgcaaggaagaatatggtgtgtccttgggcaatgactgggctgcaactcatgaatttggccacaacttttgtatctcaaatgaaggtgatgatgacgatgatgataatggcgtcattgatgtggccccagcggcatagaagaatttcgcaaaacatgcattgatgaggaggaggagggatatagtagtagtcagtgtaagcttcattctgtggtcttgcttagtaattacattacatttatgtttactcttggaatagtttctagtgttatgcttaattacggtcactataaatttgagacataattaatacatgttttattagtaattatggcttaattcctctctctctctcggacccaataattttcttgtcgatcgtctttgactctattatctgatcatagtttttgtatatataataatttgatggcaattggcaatgtacttgtaatggggtgaaggaaaatttgataaatttgacatcacccaattataaatggtttcctttaataaacttattatgatgatctatacaagagtttgctatgtgtaccttccagttcattttttccttggcagaatcatggttcagggaacacataaatcaagcttatatatatgcaaataagaaattaaattagtgagttgagtttatgacaatttcttagccatcttgtttcctaatgagggaagccaatgatccccattcaccttttaatttaattaactacaacggaaaatcctatcagaaaggagaagcgacctagctgagcactttttagtttttacactttgcatggcaattttacataaaattattcaaatgtgtttgatctatcttgagattcagagtattctcatcatatatgccttttctaatcacataattaattcattgttttctggattttctcctcatcagcgcattacaccaaaagctatatgtattgcttgaaaatgtcagagagacattatagatattatattatttggcgttatagaaagcttccttaggtttcagaaaaggatatatacaattatatatatatatatatatatatatcatgatttccaacctctcttataaaagctatctgccttaatttcttcattcactttggaattgagtccacataattcttcaacaaacgtctttcctgttttaccagcttcatctctgactgtgaaaccaaaccaaatttttccataacaaccttttcaggtcttatatagaatcggttagttagatttgttattttgttagcagaatttctaatcgtgtaaactttatataaggcttttttgttgcctacattgaagaaaatacacaaaagcataaaatctcataatatcaggaacatcatcttccatttgcttatctataattaagcaatggcctaggccatgctcatgctagatggaaagaaaatctgaagatatatataagtataaatttttagccttttatttagatgtggtgtaaccggaaccgtatgataaaattgagaagaaaatagtgctcaattgtttagaaaccctgttcaattttttcaccttttaattacaatcgtgtgcattgcacaactaaattactagttcattttacataaatttttttaaaaaaattacttagtatcgtttattttatcaattattttttgttcagtgaggcagttagttttaaataaatctaaacttttttttaccaaacagttttaacttaaaaggaattttaaaacaaaaaaataaaaatgttcataaaacttttactttatttttaaaccttaatagaattaaaaaagttgggtcaaacataacgtcataaccttaatattagttaagattttgttgattttaatttaaaagctttcactttttttagtctaacagaatccaaccattattatttttttattaaacaatccaaccattattttaatgatagcaaacaaactatcaataaataatataagcttcgttatactagtagtaatttaattaaatatacgccatatgtatttaaaattgatttctaatattcagtgacaatttgtaaaatcgttgaattgaagttaaaagtataagagaatatatcatatgttagagtgaaatgcaccacttcataaaagaaaaatattaagaatgaacgtgaaagaataaagaaatagatagtttgaaatttatatataaagaaggatagtcttgttattgagtgctctaaggagactaattaagaaatgaataaatagaaactttttattaaaaactacagttaataaactacattagagattattgtaaaagatcatttaaaacactttctcataagaaaaaaaaaatgtttttttaactaatgttaacatttttcaatttaattatctatgtgaaaaaaaaatttagattataagataagaattaagagagtctaattcaattggttaaataaaagtgtacgagtagttataaactctcatattctctgatattgatagtgacaatgtcttccatttctatggaaaaaaatgtaataagttatgttggaagttatttcttttacactgtgtgacacggattagaagaataaccatgacaaatacgcatgtcatggcaaacatgacaagccatgttaagcaagaagtcttagaactctccgagtagattgtcgttgctctcacattggcacgaccggtgcttgccaagctatgttcaatagccttctctgtagaatcaagtatctgcaaagcaagccacccacaaccaattcatataactgtttagcagtaagacaagcacgattaaatgaaaatgagattcgagaccttttcagtattttgcagggactggctcatcgtgagactactctttttgagttgttttgccaaaaccaccatttcatcagtcaaatcttcttgaatctttctaaatgaaaaagtgaataaaacagaaaaactatgaaaacacaagtgataacaataaatgcagagtatctagagagcacagtaaatgactataaaaattattgatctattacattagcacacatgatttaatggaaattattggtatcataatgataatgattcagaaacatcctcaggactagtcaatgaagacgatataaactctcaaatatatataatcctaatcatattaagctagtaacatatggtcactggtaacttactaacaatgtatcaacattgaccttaatacatcggtgcttgtcctgaagaaaaatatactttgttgttctagacaaattgacatatgaacataaggtttgtagcttgtaggttatggactctccataaaagcagtacagagtctatggatcaaccattacataaacttcaaataacaactcaaataaacagtacctgtgtttttcaatgtgtgcatgtgctgtagcatccagtttaataggtgatgtgtggtcagtctcagcaggctcatgcgctttatcttccgtacttgaggcaggtctgtccaatgaatcagatgagcaacagtaaaacagcctacaaaatacacatagtagtaagaaaggctaattttagcttacacaggccttcttctcaatccagaagaaaggagtatctgctttttttcctcaatttcagaatgtttttctttaacaaaattcttttcgaagtccttcttgggtacttgtgtgtcaatctgggttaaaaaaattgtggttgaatgattgtgcttattaggccaaaactaaaattacataaattgaaaaaaccaaaaaggagcttacaacttcatgatgcatttcatatttccaacaaagtcaacaaaaatacagccatcaaatgtaacacttttcacatgctatagtgaacatattataaaccactagctgggagtttggacagtttgcatgatgtcttgggttaatatcttactgtcattgtataacaaaaatatagtgaatgtaatttgattttctccattgtgtaataaatcctaaaagtttggttaattaggtgggaaaaagaggacggagttaaaaaattaaaatgattttgaacaaaagttatgatccaaagtaaaaatgtgttaagaacccacaagcagaagagctgagaaatagaggaaacgagtaacaaatacacaccacatgattaaccaatttggaagcaatggcttcaatcttctctgaataatcattcaacatagcctttgaaatcctgcataaccatagcagagcatttatacacacaaatgaatgcacttatatagtttcaattataattccatgacacctatgtgtatcacatggtaaataaagagacgtacaataccttggtaagccttcaagtgtcctttcttcagccaactgttctaattgttcacgcaaagtagcaacatactgcaaaatccaaaaatcgacaaatgattaagtatgtttttccagagttaacaaatgactaaattaataaaatatatcaacatcaacatcaacatcaacaataccttcaacccaagttaattggggtcgatggtagatgaacccaatgacagatacgaggaagttgaaaaaaaaaaaaggaaggggaaggggaagaaaaaaggaaaatgagtcaaaataaaagaaaataagataaaagaaaaaaaggtgaaagaaggagggggaaatgaagaggaaaaaaaactaaaaatggaccgtctccaacacagagataataatgggttatagtttttctccactccgtcctaagacacaacgtccgctaatctaaattaataaaacatatatttcaataaaattagaaaaggtttatcttcagacttacatgcacaagttttgcttgattttgctgttgaggagcagctgcaagcaacctcctcaagtttacttctgttttactgattcccatacctacaaattatctaaaaatcaaacttcatcaagcaaagaaaaacaggtatttctgtatcaaactgaaaaaaacaaaatatcagaaaagcttatccgatcaaactaccccagattataaacacaatcaaacaccctgaatatcaatcaaactatttcaaccagtttaaagttgaaaaagttaccagaattcagcaattataaaaaataccataccagaatcatggccaattttaatcgaaaactgaggacctacaacgtacttttttaccggcaataataataacaataaagttccaattcagaacatgaaaaacagtttagatattgttctcgactaaatttaccggtgaacatcttggcattctatttcctatccatggagatgtttccgaagtgaaaaattgcaaattccaacactatactacagagtaaatgctaacatatatcaaacagagtttccagaaccgtttctaaaaattcaaccccttacagtggagaaagaaaagtgtttttaattacctgaagagaagaaatcagaggaagaaacagatcgtgtctccggcgtcgaacggtggtttccgcgccgttgcttcaatgctattatgatgcgtcgtacgtaacggagtgtgcttcagttatcagttaagatccaaaatgagaacccaacccgaatccggaaaaactgaactgcttctttttatggacctggattgatagtaggtgaataacgcatccaaggcccaatgtctggcagcgttttcctttttgtatcacttttttagttttttctttgatggaagataaatttttttactttccgggaatcataagttggaaaatttaatttttcatatttggtatcaatttttaaaaaaataaaattcctgagaaagaatattttctgggaatgtttttaattaatttcgcacaaaaaaattttcacatgtgagagagaaaaatcttactttttcaaataatttttcttttactaccgcaaaaatatcatcttactctttattaaattatttaattatttaatgtgataaatatattgaataattctttgattcttaagaatcttatattaagattctaattaatattatcaaatcctgtccggactagccactctttgattctaagtaatttttctcctaccgaaggcttccttaatgacaccactctgttttttgagaatttaatttaattttaaaagtgatatttttaaaaatatcaaaagcaatgatttatattttgagagatgaaaaaaaatacatgatcaaaatcaacatttgcttattttacgaaagctaaaaatatatttaactcaattatgaataaaattcctacttcttagtagatcttaccccacctttcccacgttacacttgtgtttaaatttgtttcatgaacttgtccttccgttgaatttgagttttactttaatagcaatcggacaacattatttgtcgtggtttttctaccatggtctttatttaataatttaatatgcgcgtacataccttagtgtgaatgtggtgagtaacacgagagttcatatgataagaatgcttgaaggttacattcatcttatttttatattataccattattctttacattttttttcctttcaaatataaagattataacagggttaaaaaaaaaattacttcagcattctgctacactaaagactaaagtaaagttgggtgattttgatttgaagccttgaaggtaaaacgactttcgagttggaacttggccttgggctgatactttgataaaaactcaatgtatatttaattaaacttatttttaaaaatatacgttattttattaatttttgaaaaataaataagcatttatctaaaaatttaagtgtgaagaacatcaagtacatgtattaattagtgtgagattatttcaacttaatcaaatattttgagtttgaatcctgaaaatattattgcattaaatatttgaataaataattttattctttataataatcctatttaactcgaacataattatatcaatgtcaaattacttatgatttagaaagaaagaaagaaaaatgaagtgctaagatgaagggagtgatttacatgtatgtatccagaaaaggccaaataacattgaatgtctgatttggaaacaaaagtggtaatagctggactggagcgtgaatagagattagaggaattcctatcccatttggtgcggtgaagaagttggctgcttgctttgctatgaactatctttgtcatttggacctcaaggcttcacccccgctttctgtctctcaccaaatttaggttatgcaactttactgaatctccattatctcaattctgaacataaaatagttaacattatatatatttaacattgtgtatactttttatatatacttttgaatgaagaaaattttgattatatatcaattttatctttattctctggatcactaattatactgatagtgatttggtgtgatcattagttttctaagtagagtatctagaataattattaattacaacaaattataaaaacaaatcattggtatacttaataatatcaagaatagaggtataattaaaatataattagatttttcttcattatttttcaaaatatttttgtttgtgtattactctttcagtctcataacaattgtcatgtaaaaaaaattatcccaaaataattaatattacttatcttttttcatttatattcatttataatattaatgatatagttacaataactaataaatgaattaatggtgataagtttaattttgtaaaattttattatctttcatccatctattagtttttcttgatatgagtaaattaacataagatgataattataatgggatggaagaagtaatagtgtgatgatatatggtacgttttctattggaattagcataaaagaataaagaaaattgaaactttaaaatatgaaacataattaaatgtaaaaagaaataaataacacagaaattcttaaatgtgtgtatcaaaataagaaaacattcagcctttcctaagttgtcaacaatgtagcaacgatagatgaagaaacttctcttaattaataaaaatattcttaatcattgataatgtttttactcctttaaatattatatatttcaaacaaatcataagagcatctttaatgtggtagatcttaaattgagatcttagactactttttggtagatcccataatgccaaataggattaaaggtctttttaagatctcttccatttttttctttaatggtagatcttattttgagatcttaaggagagagaaaaagaaagaaatttcacaagaactcatcctccatggtggagatctcttcaactcttttattggaagatctaatgaagatcagactcaagatctttgcttaaaatcttatactaaagatgctctaagaaaatttgagtttaatgaattaaatggttaaaaatgacataataaataaataagagaaacttagagacgtaatgattttgtctctaatattttagttatttttttataaaaaaaaaactcaaaatgcatattcaaagacaaatttagagacgaaaattattgtcacggaccaattctatctccgaaatccatccctgagaatagacaatatagagacagttctagagacaaacaaatcagacggataattccatatctaaataccgtctttgaaataccaatttttttctttctctgctagttttcgttttttgtcatagacgtactatttttttttttcattattttagatttttttgatagaaatgctaacgacccaataaaaccgaataattacatcattcacatgcaagatattatccaaagtacacactttgatttgagcttaactcaaggctcaccaaaatttctaaaggctatttgctttcaatgttatcctattttcactcatgaaaggatactttctagtacataatgaatcatatataaaaatcttgtattacctacaacattaagtattcaattctcatgttcacgtgtatagaaaatctcttgaatggattcggagattggtctctaacttatagccacaaaatattcaagttcacacatacacacaaaaataagtaacatgatatatggtcatgtttaaaaaaatatacaattttatcaaatactactacaattaatagattcatcaagtaattatgatatttgttttaaaaaatatttctcttattatgtcatactagttaagatcaagagagaattcagattctgcattatcctttccactcgtttgaactaataatgaaaatttctgagttggccggtattcttcttggaccatttttgtaaccaaaaagtaagttacaaaaatggactcatgagacaggttgtatatttggtagatagttgatgcctttgattagttgatgtctagatgagcatgaaacttgtaccacatctttttcctttctttttcggacaatgcctcagccttatcaatctccaataatatacaccttgtccccgccacgtgtcaacatcacaatgcactctcagatagcatccaccgtgtgcatggagaattggattttccttgtttccgtttcatattgaacagcaaaatctttgcagaccccgttttcaactgacgccacatgtgcagctagccatgtttttctcgctgttgacaagcacaatactatttagtaccatttttcatgccatatttgctctcttctctctttgtactaactaggatatgttactgtccttcttcttgtttaaaactgtgccacaacctctgtcaccagactcctcaagctgaaccaagcacttgttcagagggagttttgtttcttcagtctctagttagcatctatttttatagcttctattcaacaagcagcctttgccttaaccaaaagaaaaactctttttaccttaactcaggtggggttcttctttgtttttgaagtgtatgtgtttaaatcttcttgagataatacttagtgtagctctccaactaactgtcaattttttcccactttgttgagattaaaagtttggtatttttttcagttcttgtatttctttattgttttattctttttctgttcttgttaatcaatttttgcatgtactttcaaatgtaataataggaaaataattttcctttccgggtctcttggagtttaaacattccttgctttatttattcacacaattgatcacaatggcaaaatccaacttgtggttccatttcattggtttttcacgctcttggcaagtcaagttgcatacacttgacccgaatgctttctttctttctttattatttttttctttcacttcaaaaaattctatatgcttatttgattactcaattagctgaactatgcagattattctattttactctgcttataaagtctgctctaagtttaaagttctctctcctctcttgttctaacagacaactggtttggtgaaccatgaagaacagtatccctggttgggattttgagagtgatgcatgtctcaccaaccaaagaaagcacatagggtgtgtgttatctatctttgtcaaagcaggatatataatgtccctattaactttggcttgattataattctctctgtggtcaattatacaggccggaccaagaacttgtagagctcctatggcaaaatgggcaagtagtgaggcacaaccaaacacataggaagccacttgggaattcatctaacttgagacaggtgcagaaaactgatcattcaatattaaggtctagtggtccctatggaaactcaagcaacttggatcaagaagaggccaccccatggatccaattcccacttgaggacccactggaacaagatttttgttcaaaccttttatctgaactaccaccaacttgtgaatttgaatcttacaagccaatcaagcaattggaagagggcaagtttgccaaattttttgcttctagtacctcccatcatcctactacttcaagttcaaaaccactaccacctaacatgaaatcctcatgtgttcaacgaatcgaagggaatcctaatcctatgcctgctccaagatttcatgttcctgattcatctcagaaaatcaatgactttggtgcatcaccaaaggttctaaattttcctcacttttcaacaccccttaataatgtttcttcagcacctggtagtacacagtttaggggaaaaactactgctaacttgtcacaaagtgaggctagagagtactcagtgatcacagttggttcaagtcactgtggcatcaatcacatccctcaggagccagatgtaagtagggtttcaagaagtggtgtttgggccactactaataatatgactttatctgctgagcctgaagctgtaagagattgtgtccagagaccaatttgtcctagtagtgacaaagaaaaaccagagatgattgaaccaactgtgacttcatcttccggtggctcaggcagtactggtattggaagaaattgttccctatcaacaagagatcattgccaaaagagaaaagggacagaagaagaagcatctgaggaacaaagtgaggtcatgctcttcctctttccatttaacttcatgaatgcatcttgcttttttctttttgcctgatggcctcggaagatttagtcaaaaattgaatggaatgacatgtgtgatccatgtaactattctcatttagaagaacaagattttgttgttgcaccaacattacattagtccaagaagaattagatttggatttcttagtaaggtctcatattcgagtcttgtaaatagaaaatgagtagttagaagtgaaatccgctaaagatcatcagccaagttttctgataatgactaatcataagtaaaactatcatagaagacatgataactcaaaaaaagattcgttgttggcattattgtaggctgatgagatgtgtctacatgtgtaataggccacagaacttaaagcagctgatggaaacaaggcttctcagcggacggggtcttccagaaggaaacgtgcagctgaagtgcataatcaatcagaaagggtgagcgcatggtttttttcttgtaattttgtgatttgtgttgtgtcaacttaattaactcttattaccggtgttattttactaatgcagagaagaagagataggatcaacgagaagatgaggacattgcagcaactgatacctaacagtaacaaggttcgttatcatataatgcttgttgacttgtcactgcgttaacttttttctgtagagatgcatgcatctagaccgaaaacgatgcgtgaacatttatacgctaacagacagctagagatagctagatagaaatagaagaaaaaaagaataaatataataaataatacgattgatgagaaaaaaaataaagagcataaattagatatactgtatagttgtttatgtattattattctactatgtaatattactttgggtagactcggatgattggtaaggttaaaagtggtattactctacactttctttttttttttttttgaatgattctactttttcgtaagattcaatcatgggtggtgaaaaataacaatgggttgtacgcgcagacagacaaagcatcaatgttagaagaggcaatcgaatacttgaaatcgcttcagtttcaacttcaggtacaacttacacatacacatgcatgcatgtgatgatatattctaacactagtaaaatgtgacaattttttgttgttggtgataggtaatgtggatggggcctggcatgacaccagtgatgttcccaggaattcagcactatatgtcacaaatgggtatgggaatgggtgcaccttccttgccttccattcacaacccgatgcaattgccaaatgtaccacatggtcaagccatgtctgtgcctcagatgccaaaccagaatttaatgtgccaaaatcaagttttgggtgccgttaattaccaaaaccatatgcaaaacccttgccttccagaacaatatgcacgttacatgggttaccatctcatgcgaagtgcctctcaggtaatttaattgggttctttcaagtgaaattttttcattcttctttgctttacttaatcatttgatatttacatgtgcaccaattattttttttagttcttttgttttatttttttagaagaaaagtaaaataatttaatattattatctaattataattattatatataataaatttgatagttttaaaagtcatatcaagacatttgtgatgagatgttatactcattacacatgaccaataaacttttaaactttatatgaacgttttttatattttaatcaccgttgttagttaattttatttgtttggttttatcttgcagcctatgaatgtgttcagatatggttcccaagcagtgcaacatagtcaaacaatgattgcaccaggcaataatagcagcggacccatgagtggaacagctaatattgatgatcttgttagtggcaaagcaggtaagggcactagatacttccaacttttttggatttttattcctttttaaaaagaaatttgcttgtttagttacatttcaagaaatcttaaaaaaaccaagtaatttaattattataaataaaaaataataaaagaaaattaagtgaaagcacttttaacaaaacaaaagtttatttttattctattttcctgttttctctctcccttctttctcttgctttcttttttttttttcttttcctttctctactttgtgttttatctgatatgttctcttctttctctttataatctcttttaaacttaaaaaggaaaaaagaaaattgttttttttcaaggaaactgaaaattgttaaatagtttatactttatttttaaataatttataaaatatctttaaaaaaaaatggatcagacgcatctttcaaatagtttctatgccttacaacatttaaggataaaaataaaaacaaaatatgtttttaacatgttaaatttaaccggcatttgataaggaaggaattctttttatgttcgaaaatcatgattcatgaaaattatattttatagaaatgagtaaaatttgtttggttgatgatcaaaaaatattttgataaattttctaaaaatcgaggagttatataatttttatcaagttattatatttatttatcatattaataaaaataacatgatatattgtaataaaaaaattaaacttaaaaaaaaagtaaaattctcacctcctcataaaaaagttttcatggaaaacttcttaaaaattatttttcaaaaatattattttcccaaaatcttttttttaaaagaaataccaaacataaaaaaattaagatttccaacccaaaatttaaaaaacaaaacaaaacgtctctcctatcaaacgtgtccttatgtccttatagttatttttaatgtaagttttaatcttcaaagattttaaattttttaacaataatctgtttcactatgtactgataacgtaatatatatttaaatatttcatgttacatgtcattttatactcactgacttcacataattaaatctatgtcatgtcactgagttatcttccttctccattacttcctttacactttccaggttcttccacctttaactgaataatggatagcaataccttaaaattactcaattgggggaattaacaaatggagtacgtcaatcccacaagcaccaatatgtcaaattttatgcagtttgaagttcatgctatttatatccaatttaaagtttgttgtttaacttcgaaattatatatatcaggcaagtccttgattgtgggtcaggcatgtaatcagctcctgtatgggacccatcaggttcaagcatttgatgtattgtttgtactttgtagattaggaaaagtaaattatataagttaacgtgttaatttgtactttgtagatctatatctgaacttacgataacagctattattttactatcaataatatagattagggaattaaagattgaaattcttacgttcgttgtcttttaccttagctggtccatatccatattaaattcgacacctttttgtttttttatcaactgatgacaaattcgacaccttatttttaattctcatgaaattgtgataatactcctctttttttcttatgaagtcacattttttttatactgtgacgtgtgttatgagttttttatatcaaataaaaataatttatgtcttaattagttatttaaacgggagatttttactttacataatttcattcaaaatacttaaatttttcaaccaacattaaatatattagaatgtttgtaattactaatgaaataaatttttattaattagaatactgtttgaaattttgaaaggtttaaatatgtatatattactaaagcttttatttttattggtgctaaataacattaagtactctatgcaatccaccttacctagtgcaatgaccctttattaataatatcattagtgccgttaatatttttttttctcttataagaaaaattatacagtaatacacaaaaagttaaaatggatcacaactgaatatgaaaatatctaaaattataccggtatgacactggttatatatggatctaagaaatagtttcggacaaatgcatataaataacccaaaagatacttgaaaaagaaacagtataacatattttttcaggaaaaaaaaaactatagatttttattaacaataataagtttatgcaaatagataaataataaaagtgaggacataacacgcatgatgcaaactttatacaatttaatttaatcagataattaagtaatggtaccaataacttaaaattacttaaattgaatatatcataaatttaatacggacagttatttatttagtcagcatcagatactcgtactaaaaccacaaataactaaaacatttttcattattatttttaacatttaaaattgattaatgaaaaaaaaaaactcgatagtcatcttaatatcatcttttcgttcttctttttttcactcattgtttttcattcgtagacaaaatatcccaagtcactttgcctggttggaatctttgagttcgtgatatgacatttaattcaaaccttaatccatatccaattatccatagttaaagtaaaaacggtttaggtttattttaaaaccggaaattcgttctacaatcttttttaacaagtctccctgcttattgtacttgaagtgcacaatatgccatcatatcccactgccatatgtttttattatattctccatttgaattctaataacttgatttcattatcacatctgtccccatcatctttccccacgaaaggcggagacgctcaaaaaatttgttcaaacagtgtcaactttaggataagatcatgaatcattatattttttttaagcaagcaaattaatcaaatgatgtcaaacacatacaataaaaacgacaatgatagaaggcatagatgacacccacataaggggaaatgtaatttataccaatgtataaaaaggatgtaaaattttatgtaatttttttgttctttacattttttatatattattttatacttatttttaataactagtaaaacacatatgttattgcatctgtgtatctgcatttatattatactatcatatttattatactaaaatttatatattaaaataatatctcttattatatataaattgatgtgcatattaagtttagtttaatatgttttgtaatgtatagataatatttcttatttttatctttaattatattttttcttatggtacatatacttcaattctaaagagttctttttatatatttcaaagtaagatatgtggtaaaaagaaaaataagataaatgaataaatatataaaataaatataaaaaaatatagaaaataaagattatctgaatatttttctaattataattgcaaaataaaataaaatcatttaaataatgtttcctttgatggtaattttgaatttgttatcattttttaaacatttatacccaaaattaacaaattatagaaatataaaatgatatttgtttttcgctagattttgaagtcattataagaacacattaacttaaaaatattaaaattcatgtttttttaacagagcattcatgttttaataacttacataaattcaaacaattaatcaatatagggtttatttttctaaaaaagaaaaaaaaagatcaagaagaagactttgaatgctttaaattcaagataataacttaatgttccacgaattataaccatattttttctatgttgtgtgtcatgttcaattccatccttccaaatgttatcaaaatgaatatgtaaacattatgtaaatcaaatttatactcaaaagaactatacataaaagatgaagttaaagaaggagaagagaaaaaaaaaagtagataaaaaaaaggttacagaaaaattattgtggaatgagaaaagaaaaacacaaaattacacaaagtatgattcattacttcattataccttcttagcgcaattaccaatccttcattttgtttgaaagacatatagctcagaactaacaattctttcgccaaaattaaataataaataaataaaaaaagaagcaaaatgacacttcaacaacaaaagggagtggaaagcaacaagaatgaaattcaacaacaccagcattggaaaaattaatatatatatacatacatatatatatatatatatatataaccacgtaacccattgtccgaaggctttacgttatacatagataaggaagagagatattgtacccaacattatccttgcatatacaaagatgctattttcaaatttgaactcatgaccaacaggtcaccaagacacaactttaccgctgtgtcaaaactttcgttaacaaaataaaaacccaaaagctttgtggttcccaagacacacccaaacaacatatattaggttatcttcttccaatcctttcgagttgaaccacaactgaaagttgtaaccttggtgcaactttaacattcattgctcaaaccatgcggttttttcctcaattgaatccagaaagaacaaataactaaattgaagtaacaaacactaaggaggaagtgaagaagaaggtgtagagagaaaaaaaaaaaacaatggaggcagaatctaataataattgaaataaagggtgagagagcctaattaatattaatgttaatatataaatgaataataaaatggtgtcaaagtggaaaaagctgagtgattaatgggtggttatttgatttttgtttttagttaaggggtaaaatagtctaaaaattgtggagacaaaaaatatcctttttatctattagtatagatattaaagtagtaacaataattaatcttctttagttatgctgattaaaattgatttattaaccaaaattagataatcattcattaactattcttcatttttattgtacaattttacctttaaactatttcttaaatgataaatttttctcttaacttacgtaatatcccattatttttatattattagttttttttattctatcattttttattaattatatttaattccaattttttattatttaaaaattttagagaggcacggagtctctattcccctagtaactataatattaatattaatattaatagataggtgaatgattaattcgtgccatccaacttcgtcgtatgtggactagcttcttcctctatatacctctcttcactcttcccatacacctatctctttcttgaagttgcatgttggaaaaagattgatatgtatcaactctcacaaactttatttcccaattatttggtgaaaagattatttcattatggtgttaatttatacccacaaattgaacttaggagtcattatctcgaataatcgctggaatattcatattgtcatattacatagctaaattaatcaactaactgccactaatagcgatataaaaaaaataaaaaatcgaaggctctaattattggctttctttttctttatttatagtttcgttgttgaagcaatcgggatggatgacttcttaaataggtcaaaaagtcagaacataattattactaaaaataaataatagacaaatagttatttttgttttttaatatatagaacgttgacaaatttattcataaaaaatgaaaatttaaattttggttttcgaaagtgaaaaaagtgtgataaattcgttcatccgttaacttttgttcattactattaatgaaagaacctacgtgacacagacggacaaaaatgtcacaaaataattactaacatggctgctgaatagattggagcaaaatatcagcaaattttcattggactaatttatcagataccaaattttgtttcatttaaaattaaaatataatttaatcttcatcttttctcttttttattattacaagcataacattacaataaaacacttaaaaaaataaggaagtgaacataagttagaacaaacataatattgattaataaacataacttgtgtgttgctttgaaatttctattgtgacgatattaggtaatgacaaaatcaagttgagactcatttttttttgtaaagattaacttaatagttgtacattattgtttgaatctcatattttgggtaaggtaatgtcacattataaatttcatagcaataaatatattatgcttattattatgtttgttctaacatatgtttgttttcctattttttaagtgtatattataatgttatgtttgcaatgaataaaaaaggtagaggaagatgaagattaaattatattttatccttaaatgaaacaaaatttaggatttaataaattagtccaatggaaacttattgatattttgatccattgaaaacttactgacattttagtctattggaaacttactaacattttggtcaaatctattcaacaatcatgttaacaattatttttgtaacattttcatccatctataccatgtaagaggctttttcattaacgataacaaatgaaagttaatgaatgaatttgtcacatttttttcattttcgatgactaaaatttgaattttcatcttttagagacaaatttatcagcgttctatacattcagagacaaaaatgactatttatccataaaccattataactaacctacttgtattgtgtaatttcctttgcactattaaagaagaatcattcttaatgttctgtttggagattgaaacaaaaattagaaaaaaagaacataaataaagagaagagaaaaggatggagaaaaaaaaatagtttgttgcttaattaaaaagaaaaataatagaaagacaatgtcagtagttaaaaaacttttaaaaacttttatatctttaattaatttaaatgtaatgatgaatgtgtaagtaaataaatgataactatattattttttaaaaaaataaataaatatgtttttattttcttaaatttaggctacttttattttttatcctttaaatttagttcctccatttttttaaaaagtattattttattctcttctacaataaaaaaaatcattacaaattatataccttaatcgttaaaaattaatcaagagagaaaaataaagaacaaagtaaaagtcaccccaagtctcttattcataaattaggagaattatataatattagaaaataataatggaaggttgagaaaagataaccaaataaaaaattatttatctgaaatgaaaaaatgtattttttttttctcatttctctctcaactctctgttccaaacatatcattagtagacattggtattcagctagctgcaaacaacaaatgtgatgtcggtaattttggctgcatatattttgatgtttaatggatttgagtggttggctggttgccgattggtcaaggaactgtggggtatatctccttaattgctcacaaattttgttgatgaaccttcattcttcttcttataatcttattattatatgtatattaatatatatatgtgtatatatatatatgtcggagccttgaagttgaataattagttagcagatggaagtttccgacacaactaacacagagtgggcaaaacatggccacctcatttgcaatacatctgctgtcttttttagtctttacgtgccaaactccaaaatctgtcccaatgactcgacacagcatgaagataattaattgtcttaaattaagattaattcagataaatatttttttctatttatcttttcttattattatattatatcatctattatatttgcacttatcccactttttcaaggtgtcaaataattaacatacattttgctttcacatcttttatcttcatcatgaacgttttaggacatgcaaagatatattttccaaatattgtcatacaagtataactcacctaatgcaacaatcacatcatttattaccttttcattttcagcatgaggaaagtaataaattatagtagtatcattgaagaaattaaggatttatatctcgtgaatcatgttgcttatagtaaaatatacattgaatataaggaaacaaagattacaaaatttatgaaatgcaatgaattaataattacttatggatgtagtaatatggtggtttttttcatcaacaattagttgtttacagttatatcatttatttatagaaattaaagacgatataaaaaatttccaatactcatacattttactcaattgaatataaataactaacttttttatttagtatgaattggtttttactgtgtttgttttctaattggataattttctttagttaagttaaatcatgcgtgagtgtaaacattggatctagaaggtgaagattgtgtgtatccaacaaatccataaaccatggtagtttccttctatatatcaggggtttgctaaattattcaagagagaaacccaatgggtttacttttttcggtttctcctcccaaaatataattaagaagctcaaaactgcagagccactatctgcaattgggcctatttgttttacttcaagccttgtatattgaatagtaagtgttcggggatgcaccgttgaataaaaaataacaattcttccggttttaaatataatgaataaaatattctttttttcttaaatataagaaaattccaactatatttttcctaatttattgttatcatttttaaaataccctttcatttaattgatgtattagtttttgatgactttttttaaaaaaaaattctggtaccaaatttcaatgaagaataaattagaaaaatactttataattgaaatttgtacaaataattatgagtaactaactttcttagtcaatatgaattagtttttttcttatatttgagtctaaaaggagtattaaaaaaagggtctttctaatctgtgtatatttgttaagaaactaaaaaagaataaatatttattgcataaatcataggagaacataaaaaagttataaatgatataattttatgtgtttcaataatttttttctctttttaattttttaatcaatactcaaagatacttggtcagcatttgtcaaagaaataaatagttggtgatcattgaccaagtcttttgggatcaattctaactatgatacataatcatctaatgggacttggtattcttgcacccctgattttcaagttcaccttcaactttataattctttttttaaaacaaaaatacccttatgaaaatacttgttaattgtgagttgttgttattaattattaaagtttttttcacataagcaagtatttctcataaaggttgcttcttatatataagttggatttaaaataattcaatgaaatgttttgattttttcatatgttatttcttaaaataatttttctgattttttaataaattactttttttaaaggtgaaaattttattgaaacatttttttaactatcattattaggaatgttggctgtctgatgagattcgaggtatctctacaaattttaaccccatccaaaagtgaaaattttattgaaagacttttaactaaatgacttaaatccacttttagtttctacatttatggttgatttcgttggaaagaagaaaaaagaatgacatagaattaaaaatttaaatagaaaaaaatatgtgagattcacacaaaattttataaatttctttcttttttttttcacaaccaaacatatccttagtgtattttttatttttttttcttgttgtcttccatagacgttttgaaaaacaactcctttattacttatgcggtgaactacattgaaattaatgttattgcaatttgaatgataaaaaaaaacatagcattaactgtagtgttttcaaaatttaagaattttagtatatcattattttgtcgttaatttttcaataaaaattattaacataatatattaacacgaacgtatcaacatggttagttagttggacatataactaatatgtgaaactattatgacatttatcacataataccatgtgaatgtcacgtcaataatttaagtttaataaaaaaaattgaagacgtgaacacccagatgttgaataaaatattttaaaatgccaaaattgtacaatcatgaaaaatctttttgaaggcttatgattgagttgcaaagtcgcgtaaagggtggaaatagagattttttttgacctaatttaaaaatatataatttaatatgatttatttatttgttataaatttttttaaaatttgatttgatctatttaaaaatttaatttaacctatgaacctatttttcaataaaaaattaattttacaaaatattttaaattaatttagaaaagttaaaaaaatattttttaaataaaaatatctcaatatcttacttatatttttaaataaataataattattttataaaatttttaagataatttttgaagtgattcatcatccactttcataataaaaaaatatttttaaaaaaatgaatatattatttttaagttttaatatatatatatatattattaaataagtcaacttaatagatctaacatattttttttaaagattaagtttgatctttttatttaaatagacttttcaaaaaaaattaatttaatctttataataaataagtcaggtcagatcttaaatagatcagactagactacagatctctaataagtggtctggctcatttttatcccttgggtttaaagaaagagatgtgagacgcgtggcttcggcatcctcgtcggtttgggtggcacaacgcaatcagcaatcccataaattaaaaaccaaacctaacctgcaatgcactttctttcccaatcacactccaattatatgaatgaattttcttttccttttctttttccttctctgaattttctcggaaaccaaaccccgaccaacctctctcccctaccttcgcgttccgatccagctgagagtggttgggctctgcaaaaattagctgcatgagctggtttgggaaactccgtttattctccaatttcaattcctttcacttcattacttctttcttaatttttaccctccatttttcaccccaatcgctcctttccttccaacccttgttattgatcaacgctaaaaccaatctcaatcgtaatttccggttttcgtcacaatatggagtcccgattcaagagtaatccgcaattacgcagaggtttgttaattgttctccaccgcgctgttttttttttttgtgtgcgccttttttgttcaacgtgtctacagtttcagtttaaattgatttcgttttgtagataccagtgcatggagttttgtttttctatataataatgatgcattttgaccaaattcgttatgtagtacgaatgaaagagtaatgtgaacacgtgcatgcatttttgcgtaatttgaactttgaaatagatggtttggctggtggggtctaacaatcgagcttctgaaagtgattggaagaattagattgcaaactcttcgaatctaggtgcgatgatgacgactttgggtatgtttggattaccgttgtttcaaatgtgttcagaatgaaagacacaaagaggatcattctctaaaagtacgtgctcaaaagtaggttcagaacagaatgatgagtgtatgatttgtagagggaaatattctcttgggtcatcctccaaattataaaaacagaaagttagaagtgaaatgtgcttgtgccagctcgtgtatctgagaattgtctttttttcagaagttttgattctatttttgtgtatctgctaaagttgacttggattccctccctcctccttccttgtaggcctttgctgttcaaatgatgacaagcagcaggagaggtccccatctgttattgtcattggaggtggcatggctgggattgctgctgctcgtgcacttcaagatgcctcatttcaggtattaaagttttttgtttccccctcttgaacatacatactttgtacttgttaatttatttatttgcataaattgtactttttatttgtcaggttattcttctagaatcacgggaaagacttggtggccgaattcacactgactactcatttggctttcctgttgacctgggtgcatcgtggtaaagcttactctctttgttctcctttttttcttcatgttgacaagaaggttacatttctccatgttttagtattaaaaatggatgactgtgattcaggctgcatggagtttgcaaggagaatccactggccccattgattgggaagctgggactacctctttaccgtactagtgaggataattctgtcctttatgaccatgatttggaaaggtaaaagtatctctttttttataataaatgatattagttatctatttctgctgtacttccataattaattggtgacagtagtgtatgcttcaatttatcctttgcttatactgaatggtatatattatcagatacaagttttttcttatagaaattcatcaacttcttgcagctatgcactttttgatatggatgggaatcaagttccccaagagttagtaacaaaaattggtaaaatatttggagtgattttagaagaggcaagtaatttaatatttctagttatttggtttatctgattgattactcgcttattaatacattgttttttctgattgattctattaatgttcaactccacttattatgaacatcaccacctctaaagattgaccctgctttaatgcagacaaataatgtacgagaggaattcagtgaagatatgtccatactccgtgcactttcaattgtttttgaaagaaaaccggaattgaggtgattattggcataaaataatcctttgaccaccattattgattttcttagagctgaagtaatgtataatttaattttctctgttggatgcaggttggaaggcctttcccacaaggtgctacagtggtatttatgcagaatggagggctggtttgctacagatgctgataccatatcactgaaatgttgggatcaggtaatttgacaaaaccaagtttgagatgtttgggttctattatctatatatccatttcaagtttatgtcattgaaatttgaattgcatgacaaatcattaataggtagtactagtgggctgatgtgaatgggaactttttctttttcagctatttatcgttgttgtttttattcttgtatatacttataattgaatacaatgttactcgtaaagttgcaaactcatagttatgccctataggtttgagtttgagattaaatggtaatgtgtgccgccatattagatgcaaaggatgcaatatgagatagagaagtggcttcatatggtgatcatagtcacattatgttgctacgttattgttaattactacatgcatccatcaacatttttcgtgtatgacttattcttctctgtttatctgcatacaggaagtattactccctggtggtcacggtcttatggtcaggggttaccagcctgttataaataccctagccaagggtcttgatattcgcctgggacacaggtatatattagtttaaagtttggttttggaaatctgcgtcccccgttgtgttgcttaactaaatttaatggcattgataatacctcttctcagggtaacaaaaatagttaggcaatataatgaagtaaaggtgacagtggaaaatgggaaaacatttgttgcagacgctgctattgttgctgtacctcttggggtgctgaaggcatcttggataaaatttgagccaaagctaccagactggaaagaagctgccatttctgatattggggttgggattgagaataaaataattttacactttaaaaatgttttctggcctaatgtggaattcctaggagtagttgcagagacatcttatggatgcagctactttcttaatctccacaaggctacgggtcgtcctgtccttgtttacatgcctgctgggcagctggccaaagacattgagaaaatgtctgatgaagcagctgctaactttgctttcacacagctcaaaaagatccttccagacgcttcttcaccggtaaccatgataattttgatgatttatttcacttttttactatgcaagaaaagtaaatgcttcaatccatatttatatattgcagacccctaagttttactcagtttagttccggtgcatatattctttgacaattgctatatggttgaattgaataagttgtttttcagtgactagtatgttgttggtgttttgaagatgtaatttgtttcaatcatgcagattcagtatcttgtgtctcgatggggtatagatattaatacactaggttcctatagctatgatgcagttgggaaaccacatgacctgtatgagaggctacgggtccctgtagataatttattctttgcaggggaagcaacaagtatgttgtatacgggatctgtgcatggtgcatactctactggaatgatggcggctgaggactgcaggatgcgtgtcctggagcgttatggggagctagatttggtccagccggtaatgggagaggatgcttcagtgataccactccagatctctcgtttgtaatctcaggaggctttatgcatcccctttccgggtggcatccactgtcaaatgttgggttgaacttgagtagctgggaggtgctgtgactcctagagtatgaataatctcattaataacgcggaaatgcgtaatttggaatgacatgcactcacatttagttatagttgctaataatatggtaacgcattggtgttttctttgttgtttttaagctctaccgtatttaggacttattcattgaagaactttgcacaatcattgtaagttgaccggtaggacagtaggatatatacatggatgtatggttcgtgcctcaattcatccagaacagtatatttatcatacggaactcatcgatggtgtgaagtttgctgctcacaatgattggagttccattatcatcgaaagtgattgcaaaaaggtaggtgatattaatagaaatgtaacagattggtctgaactaggtattatttatgagggcataagattagcactgtcattgtttgatgaatgtattttccactttgttcctgggaaaggtactaaatttgcccacaagttgacaatgggcacaattctgggttgaaggtttggcttggtgtttaattcttggtgatatactgactctgtcgctgtttaatgaatttgatgtatatttgaaaaagaaagataattagagatagtaaaactaacataaaatgggtttaaggaatgtgtattttagtttaattcatgatcggatttagccaataatattgccattttatcatctaacttatctccgatttttaattcctttttcgggcatttcaatttgaatgcatggattaggttggtatggtaggctaatttaactaacattacaattcatttcactcattttatacggggcataagcagaaaggaattatttgtacattattttctcaaccatgcatttacatttcattctgcattaggcctaatacaagattaatccgcagctagaatgctttttaaaccatgcctgaaaaatataagataaaaggaatattagtaagtaataacattttctaatacatttttaacacatttttaatatatattttattggttaaaatttattgaaatttataaaatcgtaagacttattaaataaagtttgacatgcaaacttttataaatttgaatcaatttcagttaatgataatgaatagtttgtttaaaagagtacaagagtgtgttaaaaaaatgttacagtgtattactattatttcttaattcctcttatgcgttgatagccagttgatctatccaacgtctcattttctgctgctctcttgatgcgaccaatactaaataaataaataactttataaataaaaatgattttttattaaaatcatagtaaaatagtgttaagagcaaattaatttttcataaaaaatattactttttatttcttactttttatttttttaattagattagtgttaataacacattcttttaatatacttttaattattaattaaaatttattaaaaaatacaaaattatggttgatactcattacattaaaaagaaaactcataattttgtaaataattacgactaatgtgtatttggatccgcatttaacatgtctaattttgaggctaaaatgagtcaaataattttttcattgatcatgatgtttggtattatattagaaacatgaattataagttttagactcaagtctctttgaagttatgaaatgaggcctttttgtcaaaactaactagagttttgctatttgttcatgtatacagtatacccttgtcatgttatttgttacatgcatatccttagttagactcaagaaattttggtaattacgttccaaatcaattttgattacaaattttcaaataacattgtgtgtcaaattaattttctaatatctgttatcaaaacaaaaatcatattactgcaaagtcatgtttagttagaataaattgtataaacacatatccaaccacgcaataatatgtcaaatacttatgctggcagtgaaagttggttttcattattagattctcaaaattgcgaacaaaacataaaattaaacagggtgaagaaacccatcaacaacattcctttagtccaaaacaagattcctatgcagctaaaatgcatttcagccaagcctgaagaaaaaagacgaatgcctctaagtgtcagcaaccagttgatctaaggtgtcattttcagcggatttattgatgcgaacaacagctttttcaaccttcaaaggcattaagaattggttcaccacttcacatgtgacaaaaaattcatgtaatataacatgtataagatcttctgatgtagagttttgattacctctgcttgccaatttgttctggcagtcagaattattagagttactgtttgtataagaactccaaggatcattccccaccaaattccctaaaacaataccacaaaatgcattgcatgaaactaatcagttacaaacttaaaaattagtgacagagatgttccaaacttacagcaactcctagagaagttttgaagccaagaacacatccaacagtaagaccaacaacatagtaagaagccaagtttacataagccactactgcttgccatccacttccaattgccacccctgaaattttccaagaaaaattaacaaaagtgtgataaaccaaagttggtgcttatgctagtgtactttttatagctttattacctgataatataggttgaatgccatttaagaaaacagaaatagcaagcaagggagtcaaattagacacagcatcaatgacgtcagagtcagaagtgaaaagtttgctcaaagaaacccggaatatcaagataattgtgcagaaaaccacactaatgaggatgctggttccattcactacgaagacagaaaattttgctactcttggatgtgatgctcctaattcgttgctgactcggacactgcaatcatggaaactaccattagcatgcttttgagaaagttgtttgaatgaaaaacacattgttttgttgcaaacctggctgctgtactaaggcctaacataaattgcatatcccagttcaagtaattcatactgaaagcacattaggataaagatattatggttaggcaacatgttggcacataacaagaaaaattattccaagacaaaatattaacataccaaatggaaatggagtccagtgagattgtgggattggagagcagccctgataaaagcaccagtccctgattgtaccatacctccaaactacattaagatacatttttagattagtagaacaaattgatgtaaataataatgtggtgtgtgatgtgtatacttatgtagggtatgtttggatagaagttggaaaagtaattttgagatgcacatttgtgatttccaatgcacaaaatgaagaatgaaggttttaatgatttgggatcaaaagtacttttgagctcactcaattgaaatccaaataaatatgtactaaatagtaatgtacttactgtgtaagacgtttttacattatcatgcaattacaaaacttatataataatcagtacttaaaaagttatatctaaagtgatttctgattggtttaactgtgtttgacggcacaaagaaattaaactcatttatctaggcatgcatgtaaagaaaattatgaggacatcgacatatagtcataccataacatcacagcagaagctactgtgagcttgaaataaggccaaattcctttgaaagccttaacactgaagcctgtccaggtttccttgcatcttggactaaatttgatgtagagaccattaaacaagacaagaagccaccaagaaaagctgagagtaagggctgcccctaaaaggccatatcccaaaacatatataactagccaactgagaagaatgtgaacaaggaacaccccaactgacatatatgcaagaggattcacaatgttctgtgcttggaggaacctctgcattggacagcttattgcaaatgcatagagttgaagaataattccgcgtgcaaacacttggccttgctcggctatgctatctgactgtcctatggcctttagaaaatccccagagaaccaatagagaaatgagagaatcactgctgctccaatgtgtaagatgattgctctttgcaatatgatgctcattgctccatgcttttttgccccatatgcttgtccacacacagtttgcaccgcacttgccatccccagctatttaacaaaatgcaatcatcacaaatatgcacatgattgaaaatgagacacttctttaaatatattatatgttatttgattgaaatttattcaaaactacacagttataagtgaaactcgttaaataagaagagtcagttaaatagtaagtgcgacttgccaaattttataatttccaatcaaatttaactatgtgtagaaagaaaaaaaatgatctagatcaccaatgcagattactttagtgaaactttaatctgattagagaacaacaatacttatggaactgcattaaattttatctaaaagaaaaagaacaacacttaaagcacttatggaactgcattttaagttttatctaatagaaaatgtattcaaaagagtgtgttaagtggcgcagcagataaagatgcataccataataccataagctagaccctgaataccaacactggctacggatgctccagcaagctctagagaccccaaatgtccagtgaacatcaaggtcacaaaacttagcatataattgaaaatggacacaacaatagaagccccagagaggagccagagaagccttgactcccacacaacaagctttgaccaccatctcaatgcaataggcctatgttccaagaattcttcaatggcatctgatgacaagttttgaatgtgtgagtgtgcgtcaagcctgggtagcaaaggttggtgctccaaagagcccatggttattatgtgcactgcaatacaagtgtcacaactagtttcagtgcatggaatgaggcattccaaataaccaattatatatgcatgcatgtggacaagtggaatatttgctccaccgaagattatgtagctaaccttccaacatgttttgttggtacctttcagttgttttcacgtgcttcttgacatagagacaagtagataaaactaccttcagttattaacctttttttttatcagccttcagttattaatttattatagacatatcacatatggtatctatatattttgtacaaaaaaaaaatgtggttgctgacaataaaaattcaaatttttacacctttgaatgattagtaggctgtcacttgaaaaatatgcgaaccgcaaaaaatagtaaaaatgtttactgttcaaagtggggaaggaatgaccttcggtagtgtaaagcagctaaactaagtcttcaaccgactgttaagaaatgagaaaagtgaataacagcatcatacatttaaaaaaaaaaaaaaaacttttttttagtaaaatataaaagttttttacattattgtctaataaaaaatcattatctataataaatttgttaagttttaatatcatcatctgtattaaacacaggatactttttattgattgaggtcagaattgctgcacaagaagtgcaagcaacaatgctgcaaaaactttcaacataacaatatatttattaaattctttacaatttacagaatgttcagttaataataaataatgtgtaaaaattttattggtatttctcttttagcaagcatgtcatcattgttttcacgaattgtcacctttcgtcgacaatcaaccatcatcattttctccatgtgggttgtgtttaattggagtggcatataccgatatacggtcttgtctttttcatttaataggaaaaattgggtgtattataataatgcttgtgactccaacatgttaatagaatgtatgaatgttacctgagctgagtcattgcttgtgcatgtgtaagcattgttattaccaaaaacaaattaattgtgttaacactggctaacacatattacagaataaaaaaattgaattattttaacaagttaatattctttaaacttccaagatattaacttatgacatagtggtaaccaaaatatttttaattttttttctcaaataagacatattttccctcgtttatttcagataaaataaaaaatatatttatatttttcatgagtttaattttcgtgcatggtgttttgtgagagttaaaattttatactattaaccaataaaaaaaaatctatgtataacttttaaaataatttttataaaaaaattaacaaattgagcatatataacaattcattcatgattgaatgataatatataaaaaataaaaaaaattattatacaatatttaagttatttcgaaaaagttcaaagagatacaaaattttatataatttaaaaaatatttaatatttcatcaatcaacttgaattaatgtacaatacagttttcaaaatataagtaaatcttcaccataggattacatgtatatgaatattcactttctaagatgttacatgcacgatcaccgtgatattatcacatgattcatgattcgcatttcataagaaatagagaaaacatagaaaacttactcgtttagtaaattgatccctagtcatatactcatatatataattatttgtatagaatatctacattctatattaggaagttcttggtaaggtaaaataattaccaagtcgtgcatattacaaaaaattaagcttaatctcaaatcaagacttgaacataaatctacttctgcctaagaaataatgtttaaaattagagatggattcaaatcatactattataacgactatcgctatcatccatgtgtttcagtattccttccaattgtcgttgttgaattgactatttgatcttgtattccaattttgaatacttcattatattaggatgaaggtgaattttagggtggaccacttgataggaggtccattatggaccatgaatcctgaccattagattaaatttagtattgcagaccatctaacaccaaatcccccagcccctccaccaaccacaattcgccactgccaaaaacgatttctgacgactacattttttttctcgccactacactcactcactgacccccttcacccatgaaccgtttttgcatgttcataatgtagccttggtgcctttaatcttaaaaggaccaagcttttttaagtgtccccaaaatgcacagcacaatgcttgttcttgttattattataattttctaaaagaaaaacaaagtttatcaggcctagttgggaccgatctctctttgaagcaaaccaacaaaaaaaatgttttaaattggatctaattcattgtgtctcgttgggtcaatcgacctccacagctttttttaaaggacaatttcagcgagacggggttttctgaaacggtgggttcctctgtcagcgaagaagaaaagggggggaaaatgacacgtcgcaaccgaaaatttcctctggaggcgatgcatggtggtcgatgtcgagggatgattggaagtaattcaaatctggagaggatacaacatgctaacaaaaggatgctattaatcagattgacctgaccattaaattgagaatggagaagttgttctctcactctctcatactctctatctcaccacgtggcaaaataaatcatgggcgatgttggagacagcaaatagcggttgctgggtgtgggtgggggatttggtgggggatgacttacaatactaagattaatctaatggtcaagattgatggttcaaaatggacccccacctatgaaggtctaaaaccatgaaggggaatataacaataacgcttgcaaggggataacaagtttcactataaaatataataacaagaaatttacaagttgacagccaaaaaaaataaagtatgtacaaatttcagaagcacgacaacagcatacaagattacaagccatgttgaaggctctcaaaaagattgaatcaacgccatctattttttttttaaaaaaatgctcaatctacaaaacttctccaagagcgttgccaattaaatcaactggctcgggtatcctattttaattcatgtgaaagtaacaaaaaaaattacttactaaatacatcagatagcaatttctgttgatctttacccagcccagagaaccactttctcaaagtttcagcattgtcagaaacagatttagaatatgctgaaagatggattttagtatgaaaaagggtttcaaaatcaagaggaagaaggccaaacagagcagtggccgcagcaacttgaagagaaagacttgctttcatggaagaggttcggcaaaaataagtatacaaataacatctcaggtttccaactcctttatcttcatatccaccaacatctactccagtcctgaaatttataacgtcatttatgactttgttataacacaagcaaaaatatgtgaaagcatctttctttgttaaatcaaataatatttaaaagtctgcatgtgcccatggcactatggctttttcacagatatgtgatcaacaaagaaacagctgtacagtaaaagttaaagagaaaaatgaaactatcaccatacaaagattctgagcgtaggtgctaccaaaaaagcagaatgtgttgtgacataaattggatagatacccattagtagttaggtgtcccttagtgagggagttagttatgttatttgggcaggccgagacagtagaagaaataaggcatattgccaataaacaaagaggagagttgagagagaaattatctaatcatttgaaaaaggataacactctttagagagtggggatagtcctattctctcgatatccagggaaatcactcattttggtatttttttaaccctagcctaaggcttctaccacactagcccagcaattgggatttagaattcaataaaaaattaaaaatcattatttccttaagatgactctaaatactcatcttagtagtaagtgatttttaatcttgataagcatacatatatcctctatcgatacaaagttaccaacatatgtatatatcattatgcatgaatgtggtcatgatactagcaatatccaagaagcagtgatcaatttacctcccaagttgacctagaagaacaattatacgaacagcaaagttctcctctgcacatgagtcaagtatattcagaagctgaggaacaagtttcatatcagcccagtgccagctctgtattaggaaaaggaaacatgcaatcaggtttgattatgatgacatcaacaaaataaagtgacaagttattccacgagtatgagaagttgagaacagtataactctcaaccataaaaaaacttgggccttggcaacaaatcacttatttcagtaaatgatggtgaataccacgagtgaaatcactttcaagaactataccatggccaatttcatattgtaaaattctattaatttcagtatggcatcaattctaaaaaaagataatgtcacttattttaggagaactactctttaattttagaacttgataaaaagaaattatagaacagggtcaatattaacttgaaataatgagaataataccgttttgtttgcaaccagttccaccaatgacaggacgtcattcaggcgacaaaagttgacattcataagggcatctggttgagtagcagaaatcgagccttttttcaaacagggcacatcacagttcttgctaatggcacattgaactgcatcctgattataccattgtccagcattataattgtctgacattaatctggaatctgacaaatttattcgctttatctcttccaagagcaaacatgcaactgcatcaatggattcagcaccttccgagaatgggcatttaacattcatacacaactcagcatgcagctgatttattgaaggaagacaagcagatgcaacagatgggctctcatcctcaagaaacataattagagatttcaaaacagtcaccattaatccaaaattatccatgttaaaaaacttctctccacccagataagcaaaaatatggagaatagtcagcaccatcagagaatcccacttgcatgaccgaagaatatgatatgaagcatcacaaataaatccaacatgatcagttgcagcacatactgatgctaatataatacttgctgctgccaattgttcacttgaagctacatcggatgatacttcattaacacaatccagaaaatcattggctctcaaatcacaagacaaagtttcagcatctactctactgtttactattacttttccctcaataagaaaatcttcaatgaggctaagcagctcgtgcaaagaataattctctacaaacaggattcttgtctctgcaacagacataactggggaaaaagatgtgaaattttgtcaaattaaaatcaaatttaaataacatgatattaatattactatataattaaaaacattcttttaatgttccgaaaatggaagttgattatgaaacaaattaccaaacctgtgcaaatatgttcagaataagattgcaagcagtggaataaattcccatcccaaagttttccaaatgtctttgttgcagtcatggcaaagttgaacagcataagtgttaacagcaccgaaaccttctccctgaaagaaattagaagaaacaaaataataaaattaatatcaacaccaccatttgtccacagttaaatattatcatgaactgatttgtttgttattacaagaaaagcaaaatattgaaacaaaaactataaagggtgctcaacagcattgaccctatactatcacaaaatgtgagacacttacttttgtgagagtttttcttccattttaagtacagtcagaatgttactaaccccccagcctgtttgagtagccaaattgcaccgagctatacaattttttgtagcaacaagtatcgtagatatgatactattgtcctcaatatttgaaaagacaacacaaaattcaggaagttgattgtttaaagatccaattccatcctccaccgaaaaagcagtccttgacttttctgtagagtgcatatgaaaattacaagaaactccataatcatcacatttttgttcattagaattgatttcaacattaattacatcaaggtaaggtgaagtaaacaggtctgttcttgagctcaacatgtcatcttggagtacttcctctagagaggtattcgtcaaattaccctcttcaaatgtttcacgaaattcaatttcaggaagagatggagaaatgggaaaatccattgcttttctatagcattcctcactggtagcatcttctaattctaataatttcatataatttccatcaggcacagtatcaaaattaactatcgaattgaaattattcacagcatcacatatcctattcccatatgcttgagaggtttctaaagtatgtggagcagggcaggaagtgtgtctacagacatttgcatcatcatagacctcagtgtcagcctcttctgtgcccttttgctcatccctgttaaccaaaggtatcatgtccactttttccctatgatatttctttctctttttgtgggcccttttattctcttcctgtaaattattcagattatgaagcacctcttttcctccgtctaagcatttgacaacttttctatgcatcaaaccatgcaaatcagagagtttctcagaagacaaatttgcattatattcaactgtgtcctgcgttcttttcctcttcctgtggtgcacatcaacagatttgtcagatggcttgaagtcctgagtcaattttgctgatgcagtaactgggaaaatggttgcatcctgtgagcccatcaactgtccatcagaaaaagattctgtactggaatttactgcagaactctgtaactttgttctgtcagatcctctaacaagaggctccaatttagaaccaatacctgtgatagatttttcagagtaatttctacctggactgaggagttgagtgttcttcatgttttccctcaatggatcacttgcctcaattgttgtgcagcagggttccagaagctcattctcaaattggccacgtgtctcagataaatttagattgcaaatttgtctcatgacatttgaattctgcatatctagtgtattctcaaactgcaaaccaatcattcaacaaagattaaaaaaaaatagttaagttgtgcatacacaagaataacatacaataaaagagaaacaaaaaaaataaattgaaaaatatatttaattatatgaactctgacctaaaaccaaggcctctcgtaaacaaaaaaaatctttaattccttcctctctcccacccccaaaaagataaaactaaaaccaagtactatctataactactaaacaattatttagtgctgatatataataaaaccacccaaataatttatgtattgctttcaggggatcctgaaaattctcatttcccaaggttaaataaactgttagtgctacagctaatatgatgataaacccaaatattgcaataatttaggggacaaccaaccaacaagttcataaccacttgtccataacataagtagtctcacttttaatctgcatatgagagtaagccagaatgagatcattggcttcaaaagtgtgcatgatttcaacagggagaggagataaaaaatgacaaaaatactcaaacattatataactacaaacaatgtcagtgaaaccaacctttgtttggccatgcatacttccaacgacaggtgaaaaggatgcatccagtatatcaaggcgttgtagaaattgaatgaaatccatctttagacgacctaaatcgtgacgtaaaataccataacgacttgcttctaacttatatttttgcctggtatgttttgctcttagcttttcaaacttaagtttgttttttaaaagcttcacttctgtactttcagcattgaccttgctgtcagcagccattgcaacaggttttgtcaaggacgagagttcatggatcttccgtttcaaatcctcaatcttctgcttatcctcttctaactgctgagacatctgatcagcaagacatttttctgtcatgaacttgttccagttatcctcagcaagtgccttctgctcctttaatttaaccatctctgcatctgcacgccttttttcctcatcgaccttttgtttttcaacctctaacctttcatttgcttttgccatccctgactcagcatttattttctctgctaatagtttgcgcttttcagcttcaaactttttggttgcctctctatacgtagaaatctcatacgccaactttgtttttgcttcgtttacctgtttctccaattgaccaatttgaaaactatacttcactgccttctccgcttcaattctggcaatctccccctttacagcagcctttttcttctcttcttctagtgacttggaagcttcagcagctttcttcctctcagagtcaacccttcttttcctctcctctataagccccttcaatctaccaatttccttttccttttcagcgacctttttcttctcttctccaagtaacttgcaaacatcagtgtcttccttcccctcagaatcatcctttctcttctccacctctataagctccttcaatctactcatttccttctccttttccgcagccttattcttctcatcccctaccatcttgcaagcttcagcagctttcttgctctcagaatcagcccttctcttctctgcctctataagcctcttcaatccaccgatttccttttccttttcaacaaccttattcttctctttctctagtaacttgcaagcttcagcagccttcttcctctcagaatcagcccttcccttctcgacttctataagcctcttcaatccaccgacttccttttccttttcaacaaccttattcttctcgttctctagtaacttacaagcttcagcagccttcttcctctcagaatcagcccttcccttctccacttctataagctccttcaatctaccaatttccttttcccactcagcttgtaaggtcccattctcatttccaccatcgccacgtccaagctgtgttatgggagtaccaatctgagactccaagctgcaagtttcactctctaaatgtgccctagcagcaacaaattctcccaatttttcctctctttccactttgaccccacatactgcagagaataacatcaaatcaatgacattactagcatattcattattcactcaactaaaccaattgcatacgcatactgcgaacataaccaaatattcattatataataccccaaaacttaaaaaaaaaaaaaataaagagttagttacctttgttgtagcgggactggatttcgttaattttttgttcaagaaccttgacggcttgtcgcagagcattccgcgattcttgggtcttcaagtatttcttcttccactgcgtatgagaaataagagaaagagaacacattaatgattaaaatcaaaaagtgaagtggaaaaagagaatgaaagtgagtgaaagagagagaggttttttacgagttcacagcaggggtttgtggagtcagatttgggagtctgacctcgattcgttgacaatgccatgttattcgcaatgcagtgaatgagtaacagattcgcttcacgagatggaagaagagtcagtgacgaccgtaacggagtaaaccctaaaccccatagcaacagaacagaaggcagcgccacttcattgttgaattcgaaacgaaggtttgaattccctcaccatactgtgatttttgggttacaatttttaaaaaaaaataacatatttagtcctttatctttttatagtttgatcctttatcctaaaaatatttagtgtgttttttatcataatattagttaattaacatgctagatatgtcttttaggatttatttaattaaattattgtgactgagtaaataaaatcactataatttatgatgatgagattatattgaccgttcgaaatttgtattgattatattaattaagctttgtaagagttaatataacaataacagtcaaaatactatattaaattgaaagaaattaaaaaaaatagaaaaaatattcattaatttgagtggattgaaaatggttaaaaacttatttaatccagatttttttataaaacttatctaattgattgtttataagacattaaatatattagaagtcaaatcaaatttataaagtttaatttagtgtagcatcatgcttcacaggttatggtaaatgaagattttagatgacgatttgaaaatgttgataaaataaatgtttggaataatcatggattgagagatatggaccatttttttaatttcaaattccgttgaaggtttggaacactttcttgttagtgatttcattgatgagacgaaggctactgcacttctccttattcttaagtggattgattttatgaagtcactaaatgtgattattgaattagattacaaacaattagttgatgctctatctcataacaatcttaaatttggttctgttgtgacaatttgtataaacttacttagtatatgtcaaaacgtcatggtttattttatcaagagacaagtcaaccaattcgcttttgtaagggtgtctaagtttcatgcaatccccaaaattttgattatttaccatcttatattgattttattattataagtggaatgccataagcctctttttcggtaaaaaaaaaaaagtacaattgaaattttttaatataaatttatcatagcattcattaattaacatattagatatatctcctaacatttatttaattaaattgttgtgcataaataaaaaaaaatcatattaaattgattatttcatatttgtattgattatattaattaagatttgaaaaagttataacaattaatatacatttgaatacatattaattgtgcaattttgtctaattctccatggatattttcctgttggaaaataaaaacaaatgtaaaaatagaaaaaaggaggaaaaaaatatatgtgcattgattaaaaaaaattgtttgatttgactaaaaatttgatagttattgtattttattaatatagtcgagtgaatcaaaatattgaatggtgcattcatagctaacaattttaccatttcaattcaaagaaacctatttaatgcatttatcaacaaaattgaattataattgaattttttttatacggactttttttataatgggagaaatgtgaatcaaagatgagtacttatatattacccaaacccttcatctgaggctgacattagtagattcttttttatactaccatttaattataatttttatgtattgtaagattgttagttttattgaatcttttgcatgtcaaatgaaattttataaatatgtttgtttttttgttttgctagagataatatgtatcttttaactgaaatgatattgtccaaggaggataggataattataaaaagtcacaaatttttccttcaagtatttaagacaaactcaaactcaagaccataattaagatagaacaattatatgtcaattgatccatttgttaggtggtttatgaatgattcttttggatcatcatattacaaatacgaagtattcattggcttaattagtgactgattttcccttaaaaacttgactttgactagacacttttagtgatcttttccctttatcacatttttttccaataaaaacatgaagaccatacacaatccccaaataaataaataaaaattccacaaatcaacaaccttttcttctctgtcactcccaatttcacaatgcttacattgagcatggactcaatttgcaactcctccttagttctaatttctttttctgctttttgtcttcttcaaccacattctttcccttccctgaacttcacgaggactctactatcgcttattggtcaaagaaaaaataaatcaaaagattttgttgtttgtgtagtacatatatattatcattttgccgtaacctaaacaataaaatattttgattcgttttttctttgaccgtgggaagagttattaaaaaaaaaaaaaaaaaaaaaaaaaccaacggcggagcctttgtcaagttcaggaaaaggatagaacgttggttaaagaggacaacaaagcaggaaaaaaaaaatagaattaaggaggagcatcaacttgagttcattttcagtgtagacatagagaaattgggagtggcaaagaagaaaggagaaagggttgttgatttggggataatgttggatctttgtgatttgtgattgtgaaaaccaggaggaagcaatttctttattgaatctgtttgatacttgtttaaaagctttatcaagcacttttttatgatttttaaccgctataaaattaggcgccacaaaatgtaataaaatatcaattaaattaatgccatatcatcattaatgactaaacaaatcataactgactctgagaaagggtaaaatttatttgttaaacatgaaatacttgtgtgtaaagataaaagcaacgagtttttttttttaaagagatactgacagacagaagagataaggagacacagaagagctcacaaatcactgagttcacagcaacccttctctttgttttatgtcatggtgctaacctttatatcggagtaaaatcaaactaattattgatatagtggtgtggtatattacaacgaagtccatgttctgcattgtggaatgctgtctttgactctgttttactcaaatttcctattttctagtaacaccctctcttcatcattggttggtgccccattattccacaaagcaagatctccaaacaactcacctaccacagttttccttgcaaattcaagcccacctacaccagtcatgaaacctccagatacaccaaccattatcacagttccttccgccaattctgtcaatttcccccaccagttcatctgacagttccttctatcacaccagttcccttggccgttgtaattcaagccatttcaggggaacaaccaatcaccaaccctgtgatttcttattcaccccaaccaggaattgttcctacaataaaaaacaccaaagctcaaaccaattgcaacataagcacaagctacaaatacagaaaaaaaaaaaaaaaaaaaaaaagctaaaaccaaagccaccattatgtctaaaagctcagtttcacaatcatatcaatccaaccaagtaaccagagaaggagataaataaattgaatcagaataatcaaaggacaaacaacaaacatgtcatagtttttttttaaaaaaaataatcatatcaatcaatctgaggggagacagttcgacatggcaaggcaatagttggttacctattaacgagcagtggaaccagccacacctatctttctctctacggatatatatacatatttatgcttcagctacagaaaacattgaccagtttgatgatataactcaaaatagtctttccccattctgcacttgtgtaaactccaaagtccaaccagcaataacaatccacaaatcttaaaaacaatttacaatgttggagtcccaatttcccatgagcatagcaaatggaccaaaattcttagccaacattagctcataatcagaatgccaacagacaaatcaaacaagatcaagactggaaagaataagttggcttcaaggaaaaaaaactcaaaattccaccataaaatccttagaaattcttgctccccgtggtatttttttcacaagataatttatcagtatcaaccaagtgactgcattaggaatgaacccattatctatgcctttatataaaagcaggcacgcatcattaaacataccctcatgacagtgcctactgatcagtgtgttatatgaaatagcatcaggacgaattccttcactctgtaacctgttaaaaaggtttgctgcctcttgaacatgacccatcttgcaaagaccattgatcaggctgttataagtgactatatctggagtcaaaccacgatgaatcatatcccgaagaaattttagagcgtcatttactttcccaattctacacaagccactgatcagtatattgcaagagacaatagtaggaaaaacccctttcccaagcatttcttcaaacaatcccaatcctttttcaactgccccagttttacagagagctttgataaggccattatatgtaatattgtcgagaggacaccctctaaatatcatttcatcaacaagcttaaatgcttgttgaactgaatctctcataagaaatgcatgaaccaacgtgttgtatgttacagtgttggcaataacaccctccaagaacatgtcatgatataaactcaaggcctcttccatcttatcattcttgcaaagtccatttattaaagaattaaatgtataaatgtcaggtttacatcctttgcttgacatttcaccaaacatctgtaaagcttcttcaatcttcccgtccttgcacagtgcacaaatcaagcaattgtaccctactgtattcagactcagaccctttgctgacatgctattcacaatatcagcagcttcctctaatcgtccttgcttgcagaaaccatttatcaatattgtgtatgtgatcacatttggctcaaagccttttgctaccatatcatagaagaattcaagagcagagaccaaatgccctttcttgactagtccatccatcattatgttaaacgtgtaggcatcaggctcgtaacctgcaattaccatgttattgtacagaagatccttggcttcttcaaaccttccactagcaacataaccactaattaatgtattatatagcacagtattggggttgggaattttgttcagcaacgcccttgcttcatcaacttgccccattctgcacaacccatgcattaaatatccatacgttaaagcatcagtgctgaaacctcgaagtagcattcgatcaagcaactttgctgcctcgtgaatccgaccagccctgcagaggccatggatgacatcattgaaggtctgaacatcaggctcacagcacatcagaaacatgtcctccaaaagccgaatcgattcactcactctgttgttttcacaaagagcatggatcaggttctggtaaatgaccgaattcggaacacacccgtgcttcaccatgtccttgagaagtgagcaagccgaatcaacctcattaaccatacacaaggctttcatgaccaccccaaacgtgtacacagttggagaaacacctctattcaacatgtcatagaaaacattaggtgccaccctggggcaatctccgtcaactagaatatccaacacaacattgtaggacttaaatgtgggatcacaggaataaacaccccacatgtccaacaaaagcctagttgcttggccaggcaatccagccttcccataatacttcataatcaatataaagagtgattctttaaaaacaactccttcatctttcatttgcttcaacaacttttctataattttgaagtccccaacagccccaagcttatcaattaagagatagtatgcatcaaaggtgtgacaataccccttttgggcaccagccctttgaaacaattccatggaagtgggaatgtcaagagggagctccaacaatttacaaagctggaatgggctaattggggtgagtgatcttctaagctgtttgaggtcaaagggtttgagcaatctctcccactctgtctctgtgtcactactactctcaggttcattgttatcattgaaattggtaccagtggcagtggtggaaagcgggaaagaagggattttgaagcaaactagcttggttctattgacatggattgaggattttaatgttttcaacatgaaggtgagagaaactaaccccaatggagccaccgcgacgtgggtcgcaataaacgaagaaacagatgctacagtgcaccctccttgttgtcaatgaaaaatgaaacacacatgtccaaagtccaaccgcgttttttgttacgatgagaggagggaggcgatgtgggttaggttccacgtttaaacgcagactacgagcgtccaaacttgaaacttcaaagaggaagctatcggcaccgttagtttttttttttttttttttatagtaactcacgcatttgttgaattaagttagattcttcacaggttttagtttttttttcttatgcaatgaataaatagttttaaatatatgaattatattttaacatcatctgaaataaataaattgtattttaaatttagataaatatttaatattttaatataaaattatttgtaactatttgatattttaaagaaaaaaactattaaactcaatttaaaaataaagataaaaaagtagttaaaaaaatcaaatatatttgtatacagataaagagggagtgacttgaaagtggttaacaaaatcaattacatagattaaagatgatttgagatggttgagaaagaaataagttgggctaattattaaataaaattaattttaaaactaaaattaacaaataaatttgaaaaaaataaaaaataattagaattataaatcatggaataaaaaaaaactataaatgttccatttttaacatggaacatttataattatgttgttcagtttagcgaatcaaatatttaacttcaaaagaaaaagtgaatgaatagaggttgtaaaaataatttagcactatttgaataaacctttttttcgactgaaagaaaattgaaaaaactttttaagcacctataaaagagggggaaaaaaacttctttcatactagtattttcataagtttttttgttttttttaaacgaaaaactgtacgcaagttaaattaacttttttaaagtattaacctatgcttgaagccttgaactgcagaaaccttatatttgacaactccaaaaaaaccatttgaaatattctttattacaatatatattgcttaaatgaaactatttttcatcagaaacatttcatttgtcgattttgaaactcaatttcacgaaaagttgtcagtagggaccgtttgtcaaatatgatggaaaattggtgcgtacgtataaaagaaaatggaacaacaacgaagctcccaaatttttgattgcaaaactaaataagagatacagtaataattaataactgctataagcaactaatcattacagaaacaaggtcacctattataatttacagtcatttgctgttgatctatttagaccttgcaaaatcactacatgtcaaccattaatgtgtataagaatgctgggccaatccatacataagaaaacttgtaacataaaattctgccaccataatttttcaactaatattccttacatgggagagtgtcctagtagtgaaaagatcccattgatgccatgccatttctcgaacttctcaactcttgttgactcacataattatcacaagagttggcaggagtagaaagtttgttacctggggcagaagtagaaggactaagacctttgcccatttgttgcacttctagtggagatagtatttttatgtaccacacattgttcacaaactccctgcaaaattatcaaatgtaaatatttctgtgcagaatcaggaaagtcttaaaatgatgtgcttcttggctatatattcattttttagtcaagcatcgttcttctagccttttactacttgggatgacatgcgcaagtaattaaatactcttctgcatggactatgatttcagtaatctcaaagcaatgaacctatactcaaagttagtgagcaaaaacttaatagaaggaacaagaaaaatggtacaaataattattcagacccataaaaaaaaaaattgtgaaatgtcgacatgttcaaattatcaaatatgtaagaaacattactgactattcctatagcatcaatgacattagcaacaatgaaggatgtagcaaatcccaagataatatattataacttggaacataaataacagctggcatatggcaacttactgccaaggatcatcaccaagaagaagaacatcattctcccggtcaacaaatacaagctgccagcctgatctctgagtcttagggtcttctagttggccttcaaggctgaacatgcgagcaagctcactaatgagctcatcatagctgctgaacttggaaatgtccagtgacctgccaaaggaccctgacttgtgaacctgtcaaaattacaccacatccatcaccatataaaattagagtaatagtaatagtcctagacagtagacaacatccacttactaattggagaaaatagtagtcctacaaaaaagaggaaacaaaactaaaaagtagctgcaatatgctgtttatataaaaatagggtcccaaatatccccgtacaatagaaccaattcaacattaaagataaatatattatataaatatatttaacttgtaccttgaacctattctttaactaataaactgttgcttaattttggtaaatgatattcaaaagtggctccgcataaaatatataaataaaggcatactacctataaacaaaaggcattagctattaccttaacaaaggttccagttggtgtatttgcttggtctacattttcagaagactgcaagaaacctgattcatccacacaactcgaagttgtcatgtttgaacttaaggggaaatcagtgactgaagcaccaccacaatttgaagcagaaaatggcaacgataatgaatcgttcacattgcctatatttctcaggtttgacatgccattttgcagcataagagaagaggggtcaatgttaatcccaaataaaagattgctctgaggatcagcagcagcatggtatgcagaatgttctcttccaggaaatggaagcaaagcagcaagttcagacacatttgattgtgatgttcccaagttttccacctgaggcaatacgcactgagaagcagcagatggaagctgaggaggttcagcggttatttgcttgggtagcatggctgcagaagacataacggaattggatccactcaagttaagtaactgggatgttccatcctgggagaatgaccctagtagactctggataggggaaacatcagaaccagaaatatgattcctcataggttcaggaaagctctgctgctggcaatgtgaagctagggcttgcatgggaggagattgagactgggtacctgatgcaaaattggacaaaggagagatgacatttggtaactgctgaacaggcaagtttttaatttgctgctgctgttgccgctgatcactgtaagggtggtaacgatgcaactgttgttgcagaagttgtgactgagcaggcacctggttttcttgaaaattgtgtagaagggtgttttgaggctgagcctgtggtaatacttgcctctgtacctcagaagcatgagcactgggaacatttgaagtcattgcttggtataactctggttggagacctggtatagaagcatcaagtctaggttgcatccatggtgtaacaccaagcccctggaagtttaaagattgcattccttgatccccaagcccaccttggagccacatgaatggagaaccaatgcccatgtctccatccttgagacctgacttacacaaaaggaaggaagaaatatattaaggtgaagatgtcatgtacttcacgacaaaaaataaaacaagcatattgtcacagatcccatagaatgccatgacatgatgacacttaacaaaaccacccataccatataaagaaggtaagcccgatggccaagggcgcctcaaccttaaggggaatggagatggatacattgggaatgttgtcaaaggttcaatctcccacaaggaaactcttggctgcctctcccctgcagtggactcatcccagccaacctacacccatagacaaaagttaaaaaaccaaattatacatcatctcatttatctgtaaacacaatctctgatatttcaataatattgctaaattctatcatgacaatgccatatagttgctatatgaatcaaacagtcataacaaaccttcacagaacgccagtgtgaatttggccagcggactggatctaaatcactaataccagttatggtacccatgtatctggacaagaacatgttacagtgagtataggttcaaatgtttaaaaaaaaaaaagaagaaaaaggggggaaaaaaaaaaaaaaaaaacttagaacagaccactgttctaaaggacaagcaaatattgtcgtggctaaacatccaaagcttttatcttttggaaggatacaagcatatattgtcatggctaatcagtcacaaaaattttggctttttatcttttggaagcacataagtaatgcatcaacagtcatgaaaaggagtgcacagcagagagtggcattaaatggcatacagaaaaattattaatacaataataatggttagaaaccaacaaatcagtaacataaaatggcaggaaccaaaattgaggaaagctaaagggaaacaagattgacttgctactgacacaactgttgaagtcacagtcacacagagataaagatttaaaggggtccaactaatactttcactgttcaagttgggatggaatcatgtgcagttacccgcattgctgattgggaattgcagtgttctgtgaatagcagcatatttgtttctttattgatatgacacagaacactgcacacccaacccaaagtactatgtggttatcaccacacattcattgataaaccacattaaaagaggaacataaataaatttggaaagtaaaattaaaggttaaatttgtaaccaaaaaaaaaaaaaagttaaattacttcataggtctcttatacttttttttgagagagaactcagttatccctatagtttgaattagcaactgggttggattccaatagtttccaaaaaaaaaaaattaagagtcctcgaatccaccctaccattagagggtcataggggactatttacaaaaaggaaactttaaaatttcaaaccatcaaagaccattttgaattttttcaaaaagtatgggtacctaagaagtaatttaaccaaatcaactgtctctctaagtcatcagacaaaagtataaagtaaacactaagattcacatgggagaagaattttttgtcctccttgagtttcttcttcgagcagggcccaaaatagtaacaagagaaaggaaaatttaagacaataaatacctaccgacgaacacttgattcttctgtctcaaagagcatcctaaatcgcatgccaacagaaactcgtgtatgatacacagctttaacgtacttggccaaaggaatgacaaattcagatgggcttgccctataaaattagaagggggagggggagcatgttcagtgtgatttgtagggtgataattctcatcattagcattagcattgaagttacacacctaggattatagaatatagtaaagcggctgtttgtggcagctgcatgagctgcagcagcaagaagaccaatgtgcatgctatcacttgacagaaccgatgatggcatgatagtctgcggacgattcgcccgccgtatgcccaagagtaactggtttttttcattcctaataaaaagaacaagaagaattacaataatatcttatagttcctttgaatagatttcaatcatgcacccgtggcctatatagatgcaattactgacgatatttctatacgggcagggtaacaagctaaaacatatttatcaggtcaaaaagctcccacagatacattattttgaaataatgtgaactaatataaatataacatgacttctagtctaaagccctcttgtaattttctttctgcttaaatatatccataataaatatatctataactaaaactgtgttcaaagatagagggaggcaaaaggagttgaatctccaataggtcaatttaatggaaatatcaaaaattacatgtaccagatgaaaaggactgaatcaccagcaacaagcctcttcgcactgacaaagacactccaccctgtagtaagaagatgccttttgggctgacctgaaagtgaaaatatgaagcagttagaagtgaaaatataaagcagttagaagtgaaaacatttaagtaacaatttaagcagctttttcatgacaccacatatcacgactgttgcttgctaatcattccttggtttcactatcgacaatttatcaaacttgatatggaaaaggatcttcaggaggaaaggaagagccaaagataagatgtatatgattaaggactatacactcaacaatataatgatccttaacacagctctcatactgttcatgcaaaacaaaaattagattggccaaggttgactaaaaattaaaaattacaacagtaatgctatttaaaatgtagtatgagtaaagaaaatgaccaaggttgactaaagttttaacacaagaaaagaaaatggccaaacaaagtaagccaagcagcgaatcaaataaggatgaaatgagtctgcaataagacagaagtaaaatagtacatctactatagtcatatcatacgcaattaaattactccttagaaaactatgtcctgcttcaaatgctactacaattttaatgttttgaatgataaaaaggaagatcccagatataagtttatagaatatcatcagatgtgcttttctttacaagaaattgagtgcgacagcataaactggacataaagaagcagatgcaaggaccacaaataattttataccaaaaatttaaaaaaaaaaaaaaaaaaaaaaactaaccacgaaatatatgcctgaatttccattcattatcatgaagatctctggcaattagttcttgagcaggaggctgctgtgagtaatcctgagaaacaaattaaagaaacacgtcagtcagatcaagagctgacaaactaattactgtgaaccaaatataacagataaatgacttacaagaggagggaagactttttcagctgctcttcgaggaacagaaaatcctccatgagtgctggtatcacttgcagttaatgttttgcagaagtagttggttggttgcttgctgggagtacccaactctgcaggcagcagatagacctccttttgctcttgctacaaaataaataatgtcaagacatgctataaaaaaaaatacaaaaaaaaaatagaaaaaggtagcaaataagagaaaagtactggacttagaggttgcagagtcatttgagcatatacttcatctgtttcagcatctgcctgcaaggtgcatgcttaaaaggttcagagtgcaagcccataaaaatgttttctgaaattctcaactattaattttattcttacatgcattgtcacattgtgaagctgacagataagttgtggtggcaagttagggtaattaggaatatgtgcatctacttccctgttggttgatgcagcaacctgtaacataaacatcaacatctatcaaataactgaagaaccaaatataaatgaaatatatgaaaagcaatcagttatttagaaatttcaaatgcaacaacaatagattagaaaagacaaccatttggcttgaaccccctcccctgccctggggaaaaaaattgaaactgaaaataaccataatgatgcaataaagagttctctatctgtcagtcactcatttttagcatagtaattatagataagatttatactgtgataatcagactgatcaaagctcggactattctagaactgaaaccttaatgccacaatttctatttaaaatttaacaaaatgctgctcatttcaagaatgaagcaatgtcatatctgctactagggacttcacttatgagctagaatgttagcaacaacaacagaaagcctaaatcaaacgtttattggagcatattttattttctcttcactcaattagcccatcctccctccctccaggcacaacaacttaaacactaatccatgaagtctgctaacatgtaacttacagcttacatctccatactttcacagtacagcagacaattgtaaatcccagtcctatcagttcaaataccaaatcaatcttatcttaaaactatgagcttgcactagcccaagcatgactgatttcaccatacacataaaagaaacaataagttgaagtctactccactaacttcggcagacagatcaaaatattacaactgtcctgctcaccgtgatcatatagatatactaaatgagcttctaattttctatacgactttatgtacttttcatgagcatagcaacttcaccaaatatccatgaaatgtgaaaaattcaagcatagtgcaataaatccaacttataggatacaagaagcattacttacctgctcactatgaccttggggaaagtacactacacgacttccaaccagaggcagagaaaccagagggccagcacaagcatgccaaagttcagaattcaaacattttttctcccctacacaatcacaggctaatatgaataaacatgaagtaaatcatttcacacaagtcaaaagggcaccacgccttagcccagtctacaagtggcatatcagtaataaactcattaaatccactgcatattttaccaataaaaaaaaaaaaaacataccacaatccgaaatccaatcacacaaacaaacaggcaaacagaataaccacacataaatagtaacacgcaatacaaccttgtcacataagaagttgaaacaaatcaaacacaaatcaaatccacatgacactaagaagttgaccctgacataaatacatattaaaacaaacaaaaacaaactatggcaacttgttcaacctcactccatgccatataataatgccaaaccaacgcctacaagttaaagtactactagagtatccttaacccctacctccaaacccatgcaaagacaaaaagaactaccaacacaaaaaacacaactaaaccaacaaaccaaggaaaagacaagagataagaaactttcaaaaagtgggagcagggcaagcagcaaaatacaaagcaatttgcacaaaatgaaagaatcaaataagctacttccactgctaccttcttcttcagcaggtgggttaaatccagaagaagagagcttcatgcttggagctataacaataggtaaggttccaaactagtaaaaactgaagcaccccaagtcgaataaaagcattattattgttataaaggtcgcaaattttgcatgcccctttgaatcagaaatgatcctatttcataacccaccccaccccccaccccaccccgaaaattgaagctacccacagaaaaccatcatccaaagccacttccaatgcaacacccttaatctcctggttctcataacacgctcgaatccaaccctaattgggagcctgaagttcaaaccctagcttcccagatctcaccgtagcggagctgaacagtggaattagagggattgggggagagaggcgagtgaagtgagagtgacattcatgtgggatttcagtggaagaagcggagaatgtgatgggagagagagaggagatagatatggctaatggctatgttactcaacaacaataatgcacagtgactggtaataattgatccatggcatggtatgtgttgtgctattatacgaaacgataacgacgaagaaaaatacggaacgtttctacgctttttcgtagatagatactcattggatactatggttttggtctcgaacccaaagacttgccaagtttggtctgttccaatgggaaacaatcgtattcgcataatcattatagacaacaaaaaaatctccctatagatgtttaacatagttgttgcattttaagactctaattcgataattaagtgtttattgagagtaattcagtctttggtgattgtcaacacctacttttaaaaacgagcaaatattaaaataaaaaataatagataaaaaaatatttataacagacttttttatttctaatacactaaaaaattgtgaaaaaaagtgtgtaaaagcattttgaacgtgcttgaatattaaatgaaacaagataactgttggctgggagtgggtaaatatatattaattataataaaaactcaaaaaattaaattctatttatatttcttcaattatttatattttatttattttaatttatattttatttttcttcaattattaatatttttttatttatatttataaaaattgaaaaatattaaattttattaaaaatataaatacgtggatttttttaaatttcttataattttttgtattagaggaaaatatcggatgagttctttaaaaagtgatatgacactataagaatcacaaaaaatactacgaaaatcacaaaaaaattgtttaagaaatgcaattggatatctcccaatgttctaataaaataataaggttcaattttgcaagtttaagttttcaccctgtaggtttttcttggcttcgattagatcactcctccacctatatctttttcaaaataaattctttctaacacacattttcggacaaaaccaatgaatgacattatgataaccctttacacacacatatatatatatatatcctttttagctgacaaaaaaatgataaagctaagagcacaaaataaaaataaaaggtctataaaagatgaaatatgcaaaaataaatttgaactaaattaatgttatttactttttttagttccactaactagttaattactaagttatcccttttttaagcaagaaattggttgctcaacagtatcttacattaatattcacacacatactttggctacatgtttacattttttataaattaaaaaatagtagatatgtatattaaaaaccatataatataaaaaattataaatcataaatttaatatttgtgtatgacacaagttattacactagtttaattaaaatgcaatgcatcaaactttttatagactttttttggctattagtttttatgataaaataaaaaggtcatatgttaacaaaaatatctaatatataatctaatttaaagtaataaaaggtctcattcccaaatttattttaagtcttattcattctttgataacaccgtttaaacaaatcacatcaataaaaataaataaaaatggacaacacattgatggagggacttaattggtacttgaaaaaatcgaggcccaaattgcacagttaaaagttagatatcaaaattgcacatttccgaaaattaaggaatcaaatgtgggattaagtttattttatattgtgaaaaatattttagattagatcatgtaatttttattctctcaaatagaggaaatttttccacattaaattttgatgtcttcttattttactttcccatttttttatggctatcattgttgaaattaactccgctagattattttttttagttaggttgccataagaaaaggagagtttttaagattttaatattttattgcgtgctagtataatcccatcatacgtatcatgagatgatagcttatttttgcatgatttcatttttaactaatttatttaggctggtgaatccttaatctcaagcattgaatacaacttattcattttaattaaacacaattaatctctatgacgaagatgtgtggataagaacaaatggaaatagtcattaatcattaaatgcttgttccacataaattcaacaaactattttattttttacaagaaaactacttgcaagcatccctcctttttaatgtactatttcctcctctgccatttgctcaagcaatgctacaattgaagtaaaaaaatatcaatgaaagtaaaataatgatgatgggtattaatatgtgtagattaattttttaaccaaaaaaataaaaaataaaaaataaaataaagtttacctgctacaattgaagttcttggtgatgggaaaacccacatcaacaccacattgtttaggaagtgcagtggctctgttttcctttaagttaggaatgtgagttgttacttcttcaaggcactgacatgcagcaattttttcatcttttgttggtgctgatgatttcacttccttgacaccattgcaacatgcagctgaaggggtatcaactttactagtgaggtattttatgcacggtgtcactgagctttttgccttttcacaattgtagcccttccctgctggctctgctgctataattgtaaggactaatacaacttgcagagttaagaatgctacagacactttcttcattttgtgaagatagtttctatttttcaatgaacttttctaggattcacttgtgttttgatgtggatggatgaaatggttgagggagatgttcattatataattgcaaatgtggtacatttctcaaccttgatgatgtgagcagtggttatgaattttgatttcttattattattattttttaatatttggagtgtggtttagatagaccatagaaaatggtaaagtatatgttgtattttgttcatactcctgtgttttggtttaatggttttgaattgtgatagcattagaatttatgtttgttttaggaatttaatttttcacagccgttggtgcaaaacaaacgataatttatctttaaaaaattatattttatttttcatttatgaaacttaaatataacaattattttattcaattctcaaattaaagttcactgaatatctcagttaagtcaatagaactactttttgactttggagtagtgcaacttgcgtagcaataaacataaattttattttgaaattaagaattgttgaatatattcattgctagtattttactattttattttcaaattaagagtcactgtgtgaaaaaaaaaatcattgaataaattgaaggttatattaatttgcaggtcattaaactatttcataatttataattagattctttttttttttagttagatacttgaacatgtatttattttttaatggttttgaattttgtttgctttagaatttattacgcatttaatttctcacatattttggtgcaaaacagatgatgatttatatttttaaaaactttaatatttttttcatttgagacataaatataacaattattttattctcaaattaaagatcattaaatatctcaatgaataaaaaccactctttgactttggagtagtgcaacgtaataaacattaaattgttataggctattcaggtattactaaacagtgtttttggaatatatgttaagaaattaaaagagataaatatttattttacaaattataaaataaagtaaaaaagataacaaaaaacatatttttctctctcaataaaaatatttaaatttaaaattatttaataatactctaaggatattaattaattttttattctaaaattgagaatcattgaatatactaataattattttactttctcttgttcttattattataaggtgtcattaacaaattttttgtcaggaataaagattttttttttaatttaattgagaacatgaaatttatcttaaattaatataatttttcaaaggcaagtgttaattagtatttttaggatattaattaataaataagatagaaattttttttactgtttttcataattttataataaataatttctcttttaattctttaatcattgtcttaagagtatcggttacccatatttctttttttaattatcattgtaaataaaactaacaaacattaatgtgttatgtttctttcttattgtcacgttattttataactaactttaatgaagggtatttttgtaaaaaaataataaatattgaaaacattttagattgaaaatcatacacctcataaaaaaacaaaagactgtactttatttttaaattaagagatattgaataaactaaaagtaaattaatttgcaagtctctaaagtcctgaactatttgatcttttatgattagaacactagagtattttttaaattgagtctctaaactttatttgtttttaattaggtctcaacaaatatctaattaaaaataaatatcagttcagctaatcaattggaaaaaaaaaaaaaaaaagttaaggacatatttaaaattggactacttcgatgagtctataatagtttatatctattcaattaaaatattcattgatccttaatttaataatagaatctttttttacacagatacaaaataattttatggttaggctaaattataattttgatttaatttaattttttattcacaattttaatctttttattttttacgaatttagttctcacattttagaaaatatgaaattttgattcaatcgacaattttgcatatactttattttttagtttgatctaatcaaatacttgatttaataagtttattttagatattatcaaaaactaatttaattaattacaatataaaaaataaaaaataaaaaaatgcaaaattgtaaattttctatgatgtaaggactaaaatcacataaaaataaggagactaattctgtgaatgaataaatataaataactaaatttacaatttagtttaatgttcataaagttaaactattataaagtcaaaaagtagtttatattaatgagaaatcttaacaatacactcttaaataaactattttgaacactctcgtattattagtcaaaatttattgaaaatcataattttatgtggattttactttttatttaattataatttattgttaatataatttttaaagtaattaaaatcaataaaattatcatacattttatgttgtgattggatgaggatataaaaattattctattatcaatgtataacttttttttctttgaaaaaaaggactagtacgtctatataaggaagtaaaaaaggtattcaatgaatattaacttaagagaaaaaaaattaatgcttattaaactgcaatactccaaagttaaaatgaagtttctattcattcaattgatatatttaatgactttaatttttcaataaatgtatgggtgtcgtttatatattaccaatatatttaaaaaaaaactaaaattaaagtataaaagacaaaatatactctaaaatttaaatgaacattagattatatatttttaagtttagacaatgtattataatttttagaaaaataatagagtaccttttatatattattaataaatgttagtcaattaataataaaatgtcttagaaaatgtgttactatcacttttcttttattattcaattaagatactcaatgactcttaattttttatatgtataaatcaaattcaaataccaaattttttacaataattaatgtatattgttcagtgactcttaatatggcaataaagtttgtattttatttatttaacacatataatgtttgaatatcttttatatattatcaatatctttaacaaaactaaaaaaaatcaaatattaaaagcaatgtgttcttttaattaatttattattattataatttaaaataaaaaactcatgtgaaaataactagataaaaatgatttaaattttttgtagtattaagaaacttttccccaatatttttagtatagtttgagaaaaaaaaaacattacataaagataaatttaaatttcatattgataagcctttttttttctttctgaagggcttgcggttcattacattaataattttttatttttttatttttatttttttatgttttatattttagtatatattttgtgcaaacaaatgggatagattaaatgcatgaaacaaacataaattttgacttcatcacaatttaaagttattaaagcaatatgaggaaatgaacagtatacaattaatgtttcaccaccattttttttaagctctaacactccaagtaaaattaataataagaagccaatctttcataaccacaccttacgtcactaaggtggttaatgtcccacatttgtagctatatagatgatacctctttcaaccttctattcattcccatcaaaatacaagtgtatcatagagagtttattgagatagaaattagctttacaaaatgaagaaagtgtttgtagcaattttttctctaatggttgtatttgttcttacagttacagcttcagagccagagccaccagttacagcttcaggaccagagcctccagttacagcttcagagccagagccaccaatcatacctttaggaccaccaaaagcagggccaccaaaagcaccaattacaactttaggaccatcaaaggcaggaccgccaagggcaccaattacaacttcagggtcaccaaaggcaggaccgtcaagggcaccaattacaatttcaggaccaccaaaaaaaggaccatcaaggacaccaattacaatttcaggatgaaaactttcttaagctcatgaataaaggcaaaagagaaaatagtacaataaaaaagatggatgctttgaagttgttttcttcctaaaaacaacaatttgtctaatatatgtgaaacaaacatttgattttgcaaataataatcaatgaaaaaatttaggtgctcttgtccatacattttcatcatatagattaattgtgttcaattaggttaaatcatttttgtttaatgcttgagattaaggataatgatctaataacttaaacaacttatatcaaaataaaactaagtgaaataagttatcatcttattagggatgataaagggtatcaagaccttatatgtaccaacaaaaatatctgtaaatggatagaacaaatacatgtttatttaggatgagttcggaatatatgtttatctataattttttaacagtgggtataaatactctaataaccctaccttacctattatatacattaatacaattaaaatattctatatatgtgaataatcacacacacacatatatatatatatatatatatgtatatattattaattataatttaatgacaagcacatgaaaccttggcttcctttcagagacgtaatgtcgatcaattctattgtcaagtgcttaaacaaatgttacgaataaaacgtgtttgcctttttaccgtcaagcgtgtaaatttttgtcaagataatcatatcaagctatgttccattaaaactattcataatgtgaatattttataatagtgtaaatttcacacaaatagccttgtgtaatgctactttaactttcataccaattcatacattgaaataactacaaatacattggaaggatataaatttcttgtaataatttcttgactagtatttttctaataatttattgactttatattctcaaattaaagttcactgaatatctcaattaagtcaatagaactactttttgactttggagtagtgcaacctgcgtagcaatgaacataaacttgttttattttgaaaattgagaattattgaatatattaattactagtattttactattttgttttcaaattaagagtcattgtgtaaaaaaaaatattgaataaatttaagtttatattaatttgcaggttcttaaactatttcataatttataattaggttcttaattttttttagttagatccttgaacatgtttttatttttaatggtttttaattttgtttgcgttagaatttattacgcgtttaatttctcacatattttggagcaaaacagatgacgatttatatttataaaaaaaaaactttaaatatttttttcatttatgagacattaatataacaattattttattctcaaattaaagatcataaaatatctcaattaaataaatagaaactactttttgactttggagtagtgcaacataataaacattaaattgttataggctattaaggtattactaagcagtgtttttagagtataagttaagaaattaaaagagataaatatttattttacaaattataaaataaaataaaaaagataacaaaaaacatactttttctctctcaataaaaatattttaattttatattctttaatcaatactctaaggatattaattaatattttattctaaaattgagaataattgaatatactattaattatttactttctcttgttcttattattataggtctcattaacaaatttgtcaagactaaagatttttgttaatttaattgagaacatgaaatttatcttaaattaatataatctttcaaagacaaatgttaaccaccttttatttttttaaccacttttctaagagtaccagttaccaagacctttttttaaaaaaaaaaattatcattgtaaacaaaactaacaaacattaatgtattatgtttctctctcattgtcacattattctataactaactctgatgaaggacatctttgtaaaaaaataataaatattgaaaacattttagattgaaaatcatacttttaatttagacatttataaaaagaataaaagagtgtattttatttttaaattaagagatattgaataatctaaaagtaaattaatttgcaagtccttaaagtcctgaactatttgatcatttatgattgattagatcattagagtatttttttttaattgagtctctaaactttatttgtttttaattaggtctcaacaaaaatctaattaaaaataaatactagttcagcaaatcaattggaaaaaaaaagttaaggacatatttaaaattgggctagttcgatgagtctataatggtttataactattcattaaaatatttattaatccttaatttaataataaaatacttttttacacaaatacaaaataattttatagttagattaaattataattttggtttaatttaattttttattcacgattttttttacaattttagttctcgcattttataaaatatgcaattttgattcaatcgacatttctgcatatacttttttatttattttggtttaattaaatcatttacttaataagtttatttaaggtatcatcaagaattaatttaattagttaaaaaataaaaaaaaatatacaaaattatagattttttatgatgtaaggattaaaatcacataaaaattaaaaaaatcaacatcttggatgaataaataaaaaggaactaaaattacaatttagtcttatgtttataaaattaaactattctaaagtcaaaaatagttcatattgatgagaaatgttaacaacacactcttaaataaactattttgaacattctttatattactagtcgaaatttattgaaaatcacaatttgtgtagattttacttcgcatttaatcacaattcatcgttgataaattatcatacatgatagattgtaattggatgatagtgtaaaaaatattatagtgtcaatgtataactttttttctttaaaaaaaaggactaatatatataagaaagtaaaaaaggtattcattgactattaatttaaaagcaaaaaaattaatgctgattaaactgcaatgctccaaagttaaaaggaattgaagtttctattcattcaattgagacatttaatgacttttaatttgtcaataaatgtatgagtgccgtttatatattaccaatatatttaaaaaaaaactaaaattcaagtataaaagacaatatactctaaaatttacatgaacattatgttatatatttttaagtttagacaatgtactatatatattttttaaaataatagagtaccttttatatatattattaataaatgttagtcaattaataataaaatgtcttagaaaatgcgttactatcactttttatttattatttaattaagatactcaatgactcttaattttttatatgtataaatcaaattcaaataccaaaaaaatttataataacttatgcatattgctcaatgacttttaatatgataataaagtttgtattttagcaatttagcacatataatgtttcaatatattttatatattatcgatatctttaacaaaactaaaaaattaaatattaaaagcaatgtgctcttttaatttattcatcatttaattattataatttaaaataaaaaaactcatgcgaatagaactagataaaaataattaatttttttagtatgaagaaactttctccccagtatttttagtctagtttgagaagaaaaaaaaaacattacatagggataaattaaaattttatattgataatatttttttaacgttttatatttttagtatatattttgtaaaaataatgtgataaattaaatgcatgaaacaaacataaattctgacgccatcacaatttaaagttattaaagtaatattaggaaatgaacaatatacaattaatattttaccattttttgtggttccaaggaacacactccaagcaaattaataataagaagacaatctttcataaccacaccttacgtcattaaggtggtcaatgtcccacatttgtagctatatagatgatatctctttcaaccttctattcattcccatcaaaatacaagtgtatccttagagagtttattgagatataaattagctttacaaaatgaagaaagtgtttgtagcaatttttcctctaatggttgatttgttcttacagttacagcttcagagccagagccaccaattatacctttaggaccaccaaaagtagggccaccaagagcaccaattacaacttcagggccaccaaaggaagggtcaccaaaggcaccaattacaacttcagggtcaccaaaggcaggaccgccaagggcaccaattacaacttccgggccaccaaaggcagggccgccaagggcaccaattacaacttccggggccgccaagggcatcaattacagcttccaggccaccaaaggcagggccgccaagggcaccagttacagctttagagccaaagccacctattacagctttagagccagagccaccagttacagctttaagaccaccaaaagcagggccaccaagagcaccaattacaacttcaggaccacccaaggaagggccaccaagggaagcaatgacaaattcgggcccaccgaaggcaggaacgccaagggcaccaattacaactttaggatgaaaacttttttaagctcattattagggcaaaggagaaaatagtataataaaaaggatggatgcctttgaagttactttcttccaaaaaaacaacaacttgtataacatatgtgaaacaaacatttgatgttgcaaataataattaatgaaacggatttaggtgttcttgtctatacattttcatcacatagattaatttgttcaattaggttaaatcatttttgtttaatacttgatattaaggataatgatctaagaacctaaaaaacttatatcaaaataaagttaagtgaaataagttattatcttattagggatgataaagggtaccaaaacccaatatataccaacaaaaatatttgtaaatgagtagaacaaatacatgtttattggggatgagttcgaagtgtatgtttatctataatattttaacaaacacaattgtggtgagtataaatactctagtaaccatcccttacctattatatgaattaatttaattgaaatatcttatatatgtgaataatcacacacacacatatatatatatatatatatattatataatttaatgcaagcacagggaaccctgatttcctttcacagacgtaatgtcgagcaattttactgtcacgtgcttaaacaaatgttacggataaatcgtctttgcctttttaccttcaagcgtgtaaatttttgtcaagatatcatatcaagctattttccattaaaaccatccataatgtgaatattttataatagtataaatttcatacaaatagcttgtaatgttactttaactttcataccaattcatacattgaaataactacaaatacattggaaggatataaatttattgtagtaatttcttaactagtatttttctaataatttattggctttataatattaataaagaacgggtaataagtgagggtatgggtatgaatatatggatatccaacatatatatatatatatatatatatatatatatgagaatgaagccaaaagttgctatccatttgggtatgagaacatgtgtaagtattttttttttaaatgtgtatgaaaacagatactatcgtatttgttatgaatgtaatatttaaaatcgctttatatcttaagtcttaagttagttattcttagcaacattgacttaaagacaactattatggatctcattcgggcttgtcacatggcccaaggcctccaaccatacataactacttcttcacgacttcacctatcaatctactatttcataagacatttcattcctacaagtaaaaagctaactttattttacacatctccatacactatttgactttagcatcagagtgttttgtgcaagtgattgcaggtctctcacctcgtcaaagatcgtcatcattggccagaatatttacttgaattctttgtgcatcaaccactgttgatatttcaccaactccttggatagagatcacaacattatccatccaaactaggggtgacaaatgtttgcatatacatacgagtagggttggtataaagactgatatggcctgcaaagcccctattttagatgggcatataagcttgatagatgatgtaaataaacatttttttcaaggtatgtattccacccgcaaaaacttgcgaataaacaaatcaatttgtgaactcaaatagtaatttaaaaaataatttttataaaatgaaaaatgtataaaattagaaaaaaaaattgatttattttttaagctaaaatctattatactataatataccaatgttttaaatataacaaattaataataataacctaaattaaagatcacaaacttaacataacaaattaacaatacttatacattaaatttagatggattaaatgagtaattcgcgaataaagtgtatcagatctataaacttaacatgccggattcagagctcattaaattcaaactttagaaaaataggtccattatccataagatttgcatgcttaacaaaacgatcaacgaatctatatccatatacgcatccccaaatacgagtaaacttcataacaaatcgaattggatagtcaaattaacactcatgagtaatttaaacaactttttttactctacctgttcattggaaagttgggagtgggtatcaatgtacccatgtactgcttatatagatgaaattacttaaatacctttacatatacatatatatatatatatatatatatatacccatgtgaccatgtctattttattaacttttcaatttcaatttgtctctattaatttttttgaaagacatctgtaactaatactgattatcattcatgtccaatcttccaccttcacacaatttcacataaagcaatgcaaaacaagaataattaagaaagggaagagaaatatgcaatatgtgtattatataattttatgtggtcctccatctgatttcatttattattatatacacaactttacagcagattctttttctcagtaggaggacacaacacaatagaagcataccattactaccagtttaatgctttcaccaactaagtactacagagtactagaaacaaaacaaaacaaatcaagtgctcttataactttagagtcatttttccttcgttctgatacagtgatatatccaccacgttcgttcattcttcggtttctccgaatctgatttctgatttgggaaaatgctcctcggattctcaacgttagcgttgttggcgtgtttctcatgttgttggttattagtgttgggcgagggtgaaacggtgtcgtgttcgaacatagtggagttggggcaccgcaccgacaacatttccataacggagtttggaggcgtgggtgatggacgcaccctcaacacgaaggccttcagagaggccatatatagggttcagcacttgccacgagaaggaggcacgctcctttatgtgcctcccggggtgtacttaacggagccctttaacctcaccagccacatgacgctgtatctcgctgccggtgccgttatcatggccacccaggtaaacaaacgcaccccaaaggccccaaaccattttttataattattttacaaaatatattttagtatcctttagtggataaagaaaataattaaaataaattattatgccaatagggtttaatttttagttggttcaataaagtaatgagagtttattgtaaatttttcgttatttatcttttattcttctgataaaaaaaagaatgtttagtaaattatttatttatttattaattacattagaagcatgaaaattatttaagtacttatttttttgagtaattagaatgaagattcttttaccaatgtcttttaatactcgttttgcgaaatcactactcaaaatacgaactgttgaatattttttgaattccttgtacaacaaacattattatttttattcaatgtagtgctttttagtttttatgttatctataattaaatatttttctattttttttatctctaacttgtaaccaatccctaaattttaatattaaattcttaactaaaatcaacttattatgtattataaaaggaaataatttatgagatttaactcttctagtgtgtgttttgtaaaaaaaatctcttttagtgtgattaattgttattaaggaaataatttatgaaagtaaagtaactaattttaattgttattaagaaaagtaatagttaatattttaataaatataaatatatgatttattatgtattgtacatcatattaatcgttaattctcttgttaacagttaaaattactcactttatactattaagtaaatttattagagaagtcaatggaattttatgcaaatgcaagcaaaagattgtcatgtcggaaaaggttattactagcgtggttaattattttttgtttgcactttcccccgtaagtggacattgtgcatatttgagcattatgcaacaaagccaatcttatcttgtatgtgtattttattaatacgtatataataaagtagtatttacaatcttgagttaaaaatgaaataattttttttattgtacttttttaagacagacgaatttgtaattgtttaaaagataatcaaatttcctttaaaaattgtcatattattaatacttaattttttctatattattttttcctaaagctactttcaaattcatttttatgctaatttttctccccaaaacatagaaattcatcctgttaaattagatatactatatattgcgggtgatttactcttttagtctactcttccttaaaaatgatatgacgcatgagtaattccaattattttaatttaattatgagcctttcttttgtttacaattctatttttttggtctcttttagtattgttttagattttttatgaattaattacatatatcctgtatttgctgaaatatttgtacggaatgcttgctaattataaagttatattaatgacatggattaagtttgctgttgtatgtaaccttttgattggcttagttaagtttgcataaggttttccccttatagaaaccttgctatgcaaaatcatgttagcaaactcttcaccgactaccaaatataacgaggagaatagaggaaaaagagagaaaggaacattaaagagtacatgtgaaattgtacatctgatgttcccgtgcataaaaaaaaaagatgttacaattaaaagcttatggttataccaatgaattgagtccatatatgtacgtgtttatccgtatgattggtggtatggagtatggactatagatgattgtaatggatcgtgggaaacatataatctccatgatctatggtgggtccatgctgaaaggatagaaagttttgttggggtgtgtggtgggggggggggggtctagtcttcatcaatgcatggcacagcatgacatttatggctttagccaattatttatatggcagcttggatttctgacaattactgtccttttctttgataatcaagtggaagtggggtactcacttattcttctggcattaaaccttgttactatagttcgtgtggttaaacaacacaaactgagatgatgatgatgactatatctatgctaaattgatttattttgaatatcatagttagtgaaatggtgcatatgaatgcagaactcttcattctttatcattgttattcccaaaaacaatgaattcatcgccaggtagttatctacataaaaaaattacaataaattcatctccgaataacgttttcatggtatgctcaattaaagctaaacacctttgtttcttccttcttaaacattttattgtttaaagagaaaaaaggaaacaaatagataagtttcagatgaacaaggactccactttctaattaatttccttcattgtttgattcattaggattcattgaattggcctttgattgcacccttgccatcttatggaagaggaagggaacggcctggaggaaggtatatgagttttatccatggtgatggagttcaggatgtggtaatcacaggtgggtatcttatgtttcctattttttaggacatctaatctgattttgtggtttgtaccagaccacatagtatactacgataatatttataaacatatttaattaaaggtgcgtttgatgcacctaagggtgcagcacatgacaaatacttgaattacatgacaattttttgtcttgtatattgtttggtggatgatggacaaaggataaaagctttacaatatctgtgcatgttttatttattcaaagctttatactgcatagtgcatattcataattgagtggaaatctttggtcctgcgagtttctctattatggttacaggattgtgtccaaactatacctttctctcacacaattcatattttcataggtgaaaatgggacaatagatgggcaaggagatgcgtggtggaataagtggaggcagggaactcttcagtttaccagaccaaacctagttgaatttgtgaattctagagatattattatttcaaatgtaatctttaagaattctcccttttggaacatacacccggtttacagcaggtatatgccactttaggtcataaggagtttataaagtgtgttcatggcattccttatgtcctttttttatttattctttggtaacattgttttaccataatgtttgtgggaaaattttataaacaaatttgtaccaattctttataaacttgttactttgtttcttgaaactaactagatctcattctgaaatctgattgcatattgtcttaacttctttgcagcaacgttgttgttcgatatgtcacgattttggctcctcgtgactctccaaatactgatggcattgatccgggtaagtagtaactgctttctaaatatagaaaggctagcaacacatttttttaaatttattgaaaattaaaaattgtgagactcacttcttatttaacaagtttcacttataattttacaatttcaataaatttcaactgataatagagtttgtaagaacgactgttagagagtacacctcttctaaatatgccatatcttgtgcaaatagtgaaatagatacaaccaattgaaatagtcaaacactatgctaagttactaactgatctcattttattgttgtaagcaatgcattttggttatagtatttcttcccttctaagatcagtatgtcttgtttcatttcggagacaaactgcactcaaagatagtcactgacatgagatttgataagtactctaaagttctgtatttatgtttctttccttcctagttaataaaccaacacttaaatactgtagtttaagggcaaaacccacaggcatctggtggttgaaatattatggcaccattttgttggtatgacaagtaaaagaacccttgtatatccattcatacaaatatcaattcgtttatgcagattcaagttcaaatgtgtgcatagaggattcatacatatctactggagatgatcttgtggctgtgaagagtggatgggatgaatatgggattgcttatggccgtcctagctctgacatcacgatccggcgtgtaactggatcgtctccatttgctgggattgctattggcagtgaaacctctggtggggtggagaatgtacttgctgagcacatcaacctttacaacatgggaattggtatccacattaagactaacactggcaggggtggatttataaagaatataaccatgtctcatgtgtatatggaggaagcaaggaagggaataaggatctcaggtgatgttggggaccaccctgatgacaaatttgatgccaatgctctcccacttgtgaagggtgtcacaattaagaatgtttggggtgtgaaggttttgcaggctggcttgatacaagggttgagaaattcacctttcactgatatttgcctatatgatatcaaccttcatggagtgacaggacctagaactccaccttggaagtgttctgatgtgtctggatttgctcatcaagttagcccttggccatgttctgagcttagcagcaaccagcagggatcatgtgccaattactcctgagattatgggaatatatttccatttttcaagcattgacaggggcaacttgggcttcttttgttgatttatcataatgtaaggcaatgaattaagtatgaaatgcaaaatgaagacttgttggttttaaaactgagtagaattgattttgacagaaataatttcaaattactgaatgtaattgagaagtatgtctaaattagtttcagtcatagattttatattaagaggtgtcacaatgaaaataatgaatttggggtttaaataaatatgccctaaatttattcatttcgttgagcattatgttaagtaatttttatactgttattgtatttttttttctttagaaaaacataagtggattttttataaaaatccaattgattagagacaaacaactgatcaattacgtgaattccaaaagttaccctaatgattaaggaggttatactaatcaattatggtcattcaaatattaatttagataggcttagcatttagcaaaaacaatataaatatagatacaagagtaacatttacaaagaagtactgctatagaaaagcggaggaaatatatgagatgtgaaaaagactaaaacaaatcattataagaacacgagactaagagactaaactagataacgtgtctaaaaaccaatctaaggaaatataacatcaaatattcaattggggtaagttttcttttctcttatacctaaaactctaataaagtttatttatctttaagcttagggcatgaaattttactttttcttcctttagaatatcatggaagaacaactaaaacaaagaaaaatcataaacatttgaacttggagtgagagattaaaggcataagaaaccaaacactagtgctcagtttggattaaaaataaaataggaagaaaaaacaagacagataaaaataagaatgatgcaaaacaaaattagataaaaaaaattaattgtttgaattaaggatgacattagagcgagactgatacatgtaaacgtgtagtagtcctcgtcaccaattccattgagtaaaaatccatctcatactctctatacccacaaattttatcaatacttgtgggaatccatggatacttgcaaagatttctttttttaaaataaaaaatttaacaaatgtgctaatcaataatttatttaaaatacttaaaatccataaataccccaatcaaaatacttcaatttagaagttaaaatatttcaatctaataagtccaaacaaaagattgagaaaaatacttcaattacttttttatttatttctaataccaagttccaatgaatagtaaattgaaagaaaaaaattaattgagattgatatcattaaattggttaattaactttcttagttaatatgaattattattttcttatatttgagatcgaaggaagtattatccaataataaattattatgtataatacactttttatttttcataatagttattttaaaaaacatatctttagtgatatccaattaattaagtttttttctttcaaaaaaaaaatatagactatgaaatggaataatgtatactcttaatttatgagtatggatgatgcaacgaaattgaagtaaggataattttttttagaataatatatattttcacaaaaattaaaatgattttatatttataaatttgcattatttgaaagtcaaaaaataatttcaattaatgaaaaatgttagtaatatactttattattgattaaaatttattaaaaattataatttttatacgtctcagttcttatttaatgaatatctcttcaaattttataattttaaataattttaatcaaataaaatataagttataaagaatgtgttattgacatttaaaaaaatgaaagtgtgttgacactatttttctattcatttaattaagataggatattcaatgactctctataaaaaaaagatattcatttaatgactcttaatttaagaataaaacaatttaatgcttattaagttacgctactcaaaagttaaattcatttaatttagatatttaatgacttttaatgagagtgactccttatcattgagttttgtggtgaggaagaaaatggaaagaatggaagtgaatagttataaaagaaaagcagaaaaataaataagaaataaagtgtaaatcaatattttttatttatgaaagtgaaataaaatagaaaagagtgaaactaaatttgttgaggatgtttgatttgaaaaaaaataaaggaaagtaaatgggtaatttaatgaaaatatcattttacccttagtctaaaacaggtttatttatttatttatagccaatcttgaaaaaaaatttgatcagtgcgtcatttctcatagaacttgaattcacattaattgcatttattttatcagcgcattaaatgcaaatttgatcaagcggtgtcttttgtttgctagctcatgcattaatatgctttaataaattgttgcaattggagcacaacacgtggattccacttgaacatgcttgcgtcaacttttgtagctatatatagccaacacgtacatttctcacccttcaattcatccccataaaaaacaagcaaattaatcccataaagttcattgatatagaaactactagcttcacacaaaatgaagaaagtgtttgtcacatttttagctcttctagttgtatttgttctcacagctacagcttcagaggcaccaattacaacaaattcagcaccaaatgactacaattgttcacaagtgaataacttgttaatttcgtgcgtggattacctcattggtggagatggtatcccttcaggtgtttgttgccaaagtgttaatgcattgaaagcatcagcaccaacacaaattcaacgaatggctgcatgtaagtgctttttcgacgtagcaattcgccttccttccttgctagaaaacagggcaggttcacttcctaaattatgtggtgttgatttgggttttatcatgagcaagcaaaacaccaattgtaacaagtaagctttctttttatttccttacttcatttttatcttagtaaaaattaatccatcatactaattagtcatcattagttattttgttttcattgacattggtttttcttcttctttctttttacagtgttcatgtaagctcagggcaaagggggcaataatacaattaaaaggatggatttttggaagtttcttcttgaaaaaaggaaataaaacggcttgttgaatgtatgtggaacaagcgtttcatgttgcaaataataatgaatgaatattttctgtgtgttgctcttatccatgcatatatcttcatcacatagattaattatgtttaattaaattgtgtttaatgcttgagattaaggataaggattcgccagcctaaacaaattgtatcaaaataaaactatgcaaacaggttatcatctcatgagtcatggcatgatacacatgttgggatcaaagtacacaacgaaatattaagagctaaacgaaatttctccttcttgttgcaaactaaccagaaaagtatctaagctaagccaattttaacagtaatactgcaatagtaataaaagaaatataaaagcaaaaaaaaaaaaaaagtaataataacatggaaaacttctctcaatgtgagttaactcgatccaaagccatggaaacacgttttctccattaaaatttaagacgagagtgtaagttaaattctttccatccaattataatttttagacataactgtatagtattttatacaaaaaattaaataattttaatgtctaaaatctttcaaattgctttcaaaagaaaatcttccacattggcatcagtaatttagtggtgtatataggcagaagatcttaatcccaaaatcatatatactacaattgataattaaattacctaatgtttttcacggataaatggtattatattcttttaagatttttttttttgaaaaaaaaattgtagagtcggttttcttcaaagtactattttaaaatatttttaaaatgcaaataaaatactagtacataagtgattgtgttaacattagttttaataatgaaagaagtttaactcaattaattggctactcataatatatgttttattctatgctttttgatacctatctttaatttttaaggataaaaaaaatcaatcttaatagttaaaattgattattaaaaataaaaatgatcaagaaatagtgattatatcataagtattaaaataagttatttttttactttaattcttaaaatctacgttgataaaactgataataaaattaatcacctttatcaagaacacaatttaatttactcgtaacaacattgataaatgaatgaaagggggaaaatgaagaagcactagggtttgctattggttcctacaaccctcaccctcaaaaatcacaaaatagaaacataattatgttatgtatttttttaaaaaaattattattaaaatgattgattaatatttctttagccaatagttaaatacaagttatttttattcttaagatctttcaaatttgtaatttatatttgttactctcaattagaattctatgataacggttgttattattatacttttttccagatttttgacggcttgcaagaaaagggatatcatgtgattggatgcaacctccaatggaaggggtgatgtcggtgagcttgctgagacagaaaggcgtcaatgtgtgactgcgcagcacgccgtgatgcagagatttaacgacaaacactatttcgctaaaacaccgcaaatataaaaaataaattaaaattgacaatatattttcgttgtgttatacaatataatcatgtttcccttatacataatacaatgaaaacatgttttcttttttataacataacgtaaacatatttttattgtattattcggaggtaaaaaaaatataaagaaaaaaatatgattatgttgtatgtgtataataaggaaatcatgattctataaaaaatgacatttttggagagaaaaaaatcttgcctatattgtaaggaccaatagcaagagtattgggagcaataacaaccaatagcaagcaagtccatgaagcaaatgtggctcaccttagaagtttaggtaagaagcaggcaaaatagatattttctagccaattttatactgagccaaaattttgttaaatcacaaccattgattaattattgcacataattaaacaagaaatagaaaataatcaacggttcggatttaggatgcaaggaagctcgtgctgcagcggcaggagaggatcgaaaaagttggagtgaggtttttcatttttgtgttcacttgagaagcagaagcagaagcagaagtagaagcccgtgttgagttctactttccactgcacaaacagagcacaacgcgcacacacgccatcgtcatgtttctgccagaaacgctgtttgttagcgccccgtcgctgtcactatcactgtaactgtcatataaaaagcactttccctctcttcccaaatcttccatttcatggctattctacctcctgctgcttcttcacttccctcgtcttctggtaagtatcttctttctctgctattcaatttccgaattcctgttactctttcaactcattcgttatttcatttctcaataaaacgaatgagcttactgctttttgtttctatttctcttttctgtttggattctgcaaaattttagaaacttgcttcgactcctttataagaaattttcgtgctcgtgcatgcatacgtaggggaaaatgttctcaagttatgaggctcaatcgagttttaaagaagaagaatgctgacttatattatttattcatttgctcttacaataatagaactgtggagttcggcggagcaaaataaacaaatgaataaattaaaagtgttttttgtaatgtattcggtcttcagattgtgaagaagtccaaaatttttagggctaaatgcagattttaggaatttgatcatgagagtgagtgcaaaattctgattcagagtagatttttgttttcgattggtatagcttagatgattgttaattattttatacattttgagatttcttttgttttatgcgatttgagatacttacctacactacacgtgttaacatctttgacttgagattttaaattgtgttcgagtgctctttctattggatgttgttttcatctttgttcaacattgtgtgtcttgtagaggggatatgttgctctacttatggaataacaagcaattcaatcaaacttcctattgatggccgaaggtggcatgatcttgccagcacaaggtgcttacattacatgaaggatgattatttatccttattcagctttctcttgcttatagaactgtattagttatagtagatgtgggatcatacagtttgttttttaattagagactaggaaaatatgggaagatgttttagacgtatttgcatccatgatccatatcagtatgataatcatctattttgagtgactccccccccccccccccccccccaaaaaaattatctatatagcttagcaggtttaatccatttagttttacgctcaatgtcaatccactttaactagaactcaaattgttaagcggagtccaagaattatttttataaccctaacacatgaatcctggatggatgctaggattttagttttgttgcatgattttactaccggtaacctaatatttatttcagatgaagtacctagaaccctcaaaatatttttattagtctcttccttctcctgattctgcaatcaaatattccatttactgtgttgtttgaaaattcaaaaaactgtgatagatgcaattatttatatcggtttttttcttgtcacttgtcaattcttgtcctggtaatcattcttcgtgaaagatctaaaatgctttgtttactgaaaatagttttggttatctttaggtgcaaaagtccattttttggatcaccacacttcctttggctatccacagggcatgatctgtgcctttcaaaggttaatgttgctgcagactattcagattctatacccgattcttctgatcacatggatggacaaggttatcatcctcttgaagaactgaaaggttccaacgatattcagccagctagactctctcctgctgaaatagcaaaaacaactgtggaggtttgtgcctatatgcttttgtgcacatgaaacaagttaatttgtgatatctagggctacagacctagtacacataatatgatgtttccattttgctggacgcattttggcagtatctgtatactttttatcatcatgccctgtttgttggcattaggctaataaaagcgctttgctagtatttcctggaatggtacactgtgaaccacatgaccagatttcatgggctgagtttcaatatcatattgatgatgttggaggtttgttttctttttgttatgcatatatttttgtttatgaaatgagaattattagttaccttaatgaattcctgattcagtattaaacatttagaattataacctattgcttttgtttcctttttttttttttcctgtagatatatattttgaaatctctgatgatgcaaaccttttggcggattgtggagccaacaatcctgtggtaggaattttgtatccgttttcaaagggatttatttgttatacatgctaaaagattggccaaatatacttagctgtgctgctgttgagcttttttttttcttccctctaatgaatattccatatcctttgttcttttacttctttgtcttcccatctgataagaattatttttataaaaaaatatttaatctctttttaaaaatattgatggaatttgcaggtagtaaacattttaagaacccccaaatgctttgcttctgggaatcatgtgatgggtctttctgtcaaacctctgtgcacaatatttctggttataacttataagtcttaggcttctaatctcttgcacctacttttcccttgatgctcttcttttctttattttttatgtaattgggactcccagttagatttcatgtcttctcccaaaataaaaagccagtcatagatgagatactttatttcaaattatatgaaattattaatacagatccagagattatgtagtcattttaaagtattaagtgattcaactgtctttgtgcaacaactattaaagtgctaaatttgtagtttggatgataaactgaagtagttttgtcatggtatttttgtgttccataccctatctttgacatagaagttgtgaaattgatattctaagtccgtgtttcttcagaatgctttctttggaatggacatcccaatatatgataataatagaaggactgctagtgaatatgacattttcaataacggcaacaatgatgaattcaaatttgatgatgatgatattgaggtttgccttttcaaatgcttaaattatgaaatttattcagttgttttagttactaattgtttctttttatgcatctgagaaattcaaatcacaagtatattcttctgcaaacaggtttcagaaatggaggagtttaatattccagtgaattggggacagtctgatactacaaactccgttcatccaatttatttctcaaagtgcttaaaaaaggttctcccccccctccccccccccaacacacacacacacaaaaaaaaaagaagaaaactgataactaattttcaagtttcaacatgagaatgatttaacagattcataggctctggaagaaataacattgatcctttatgaattttcttataggccatcaacaacatggtatatgttaaaagaatgaaccatccttcaaatggtgtttctataatagggttccttagacccgtttatggtgaagaaaagtcatatctaagatggatgtatcatactgaagatggcgatgtatacatctcagactggagaggtatctgttctcttcaagtttgatatttctgatctataaatttcctttttatacttttaatataaaatcatggtgagttttttaagagcatttttttttatcagcaaaatatatgtattatattaaatatagatgagtacaagtggtacttttctatttacattgatgccctactatgtgtaatcctatggagccataatacttcctaatactgcagtattgcaagaattaggagtccataagactatataggtctttgtacccctccagaaaaaatatcctataaaaccaccctcccctgattacaaaatcctatccttatattactggcccaagaatggaaagggatatcaaatcctttttccagatttttgagccatgaccagcagaaaaaaacagcatcatccaacaacttttgaccattgaaaccttcatttgagaagaccaccctattcctatggtaccatatgcaccacgtcaatgacatccaccatgtttgctagcgctgagatcttatgcccttgagataaccatgtgtgtgctgaagaaagtgatctctaggagtttccgggtaaacaccgacgatgtttagccacgataatgcttcccaccatagaggccggatttgtcacagccaaagacaagaggtgacgcatcctcctcacagttactacaagaagggcagattacgtcattcagaggcacattcctcctacttagattcatctttgttggtaatctatcccgaatcaacttccaagcaaaacatgacattttactgggaactttgattttccataactccttgaacagaccatcattattcacgcctgatggacagctacttatcaatttgtaagcactggccactgtgtatcttccactagaatctgccccccaacaccaattgtcttgctggttggcctgcactaccaccccttcaatgtcctccatgaatttagcaaccataacaatctccgattccctgaaaaatctcctccattgcagctgccactcccaacccccctctgctgcacaccccaactgatgtataaagtgatgatgttgttgagatatgctgtacatatgcggatacatttccaacaacgactcctcaccacctagccaaacatcttcccaaaacttcacctaaaattaagagcatgataggttacctatcagagcaactctatggataactgtataaatttcctaaaattaaattttgtagagcatagatttttattgaaggggaatgttaagtttcttgtgttggaagttggagtaaaggatataattacacatttacaccgatccagttttaacttttatatgttactttatgtttttattatgtaaagtaatttattaatttgtaggctaccttttatatgcattttatatcatactttcttgccatgatgcatttctgaagaagaagcatgttaaagagggcagagtgctctgtacttcctcagagtttcatattgcagaaggatcttgtttagttgactaaagttgtggtactttattgaacactcaaactttggtgctagttgtttgggttcagctacttttactcattggttcttgtctaggaaagctaatctaatattgcaatatcaatataacaacaaagcttgaagcttgtcattgtagttctctgagcataatgcatttatgtaacttgaggaggtagagcctcttcttcctcagtaatatgaaatcttagctttgacaaaaaaaatgttgattaattggtaaattgccttttaactttttttttttttttttccttttcaatctttggatggtgaagatttttactcaaatagtgatgacgatgatgaaagagacactaatttgacactttatcgattggagatcctgtcaatcgagctccactccatgtatggatatcaggcatgtatctcaaaacagatttctatccctacatctatctattcttaaattatatccgaatagtcaagatttaaaaaaaatataaaaaatgcagatgactattttaagtagtcatgtgaccactaaataacctttaatcttgacaatccatgtatggttatatgacctagatttatagctctgacattcttaaaatgagaattatttatacacacacaacttgctagcatacaagtgggtgtatgttagcacccatgtggttaagacacctacttgtttttagaaagaatgtgtaaacatgttataattttatttttaaaaaatacaccaaaaggtgtagcttactaaaatattcctagaaagcaagttaccaaaccccgatatttttctgtaatttgaagcattattaagtttgttgagatttattctaaattacaaattatgcatgttctacctatccacaaaaattgcagtctgaaattagtgtgctagactttcaagatgctgaacctgatatacttgcacactcttgttcggaaattctggaacgcttcaatcgattctgtgatgatgaaattaaagcactttgcaagaagaaaggtctttatggcgaggtaatccaattttttccccactctaaccaccatgcaaatctttcaagtaaatcaatttcatcatataaagggtagtaaaataatttgacatttatttacatacatcttcattcttttcctttatgaaaccaaataactgaaggaaagcctcccttattttccattcgatgatatctgacaaggaaagtgatgattcctttacttctctccttttcttttctatgttattcatttcccttcatgacaccaaacaaaacactcacacataggaaatgactattatttggttcgttatatttttatactttgattttgtatgtctactgttaatagccagttgcttatttcagtgttattacatggtttccagggagcttacctggttggggttgacagccttggtgtggatgttagagttctttcaggtgcagaagtaaaaactcatcggtttccattcaaagtccaggtaagcgttgtgggtttcaactgaatgtacattatttcagattgattctgtcatggaccctcacctgaacatcctggtgagaacatgtctattagttattaaaacaatctagatcctataaatctctcatgggataatttgaggcttgattgtgtaagaagcttatgatttttatgttatccagtgtttgatgtggcatcttaaatgataatgttaaaataaatccaatgttatataatagcccaaaaaatattttattggcattattttgtaactagagcagtattatttgatgaatttattttaataatatttgaagcaaaactacaagtccaaggttctaagtcaactaatttgtcacacacatatcacatgcttgtgtagcacacaggaagcgaatttgaacgggattctccaaaaatgtattttttgtaatatttaggaagtgagcttctcaattaacggtttagttaggatgaagatgaaaaagagaagggacaagtacaaatctccagggccactgctgcataaaatgcaacaaatgtgttgtattgtcattggttggttgtgggctggggtaaggtgatgaacatgtgatcagaagagggaacacactgttgtgtttgtgtaattgaccacacttgaaagaagcctttacagtccacaactgttcatttaaggcatttttatctaatggttagcaagagccaatcacgtaggctatttcactccataggcttggacctacataagcatttctatggggcgataggtataaatttgcttaaagaagaaatgtccagtatggcatttttcaaattcattaatggattttttttctccaatttgcaggccgccaatgcaaatgcagctgaaaaacaaatttggcaactattgtttcctcgctctcggcgaaagaagaatatgaagaagtggcggagttccagcatgatttgagtatcccttggtgattggtccttcttttttgactttgtccttttcaaactgctggtagagtctgatatggagcaattgatttcttatggtataaatagtactataatctgtacattttttccaggtaaatccaaaacataatttttttggtaaatcatcagagtttaggaaaagaggaggtaggggtgttgtcactccagaaaggagtattggtggctgccaaaactaaacctaggcttcaccaggtttacttggttgttccttaccagctaaatcattcccctgttggccctataattttacttagatttgaaaggggtcaatggcggttatcttctttttcctcctctgacttccttatagataagaagtattaaaatgttagctttgtctttgctgaataataagtaatggcatttatggataaaactgttacctcaagatatttctcaacatgatttttttaatttgcaattattctatatgattagcacatttttttttttttatagttttgagttttacaatggtttatacaaaatataaaagatgttgccacaaattagtttttgtatttagtacattgtttatcttccaaccttttagtacgagacaaattccagagctagagcagattattttggtgaccgcatcaccagtatagtagtatccttaagaattactattaactatatatttgtgtgtttcgtcttgtttttttgttttttgtttttttttgttttttgtctcaagatatttttaagttgaaaaataacttgaaaagtttttttctttgacgttaactttaaaagttcagccaaagatttttggtatttttttcacttttttttttcttaaagcttttttttggcgaatcttaaaataaataaaaattggtctctaagttgcttggttagtataatactttcagaaaagcccttacgtttctaaatttatggtcaagaatacgtaactgcaaacttatattgaaacaatactgtaataatgatagaatttcataataaatgctcatagctagtaataagtaagcaacattgtaacaaaaccaacacatataattcgtataatagaagcatacttaaaaaatatgctatttcaatgaaaagacgttgaaaacagacgttcattgataattttagctctaaactacagaacatatttcatcttccactctatgactgccactggaattatgtatgctcatcttctaatatcaacagatatgacaagttattatatgtgacattttcaatgtgcaatattgcacttatgctgttttttaaaattccttcgcttgaaggatatcatctattacgtgagctggagccattcgtttttgaaatacattttttttacttctgaaaatcttgcggatattttatttagttaatttataacaaatttttattataaatgttatgttaatatgccgagaaatttcacgactttaaatattgtttatgaagaatttttttatactttaatataagtaagttgctaatgatttttttagttaatatttttttatagtgatgtaaatatcatattttacttaatttttggttaagaatttaaagcattatacgtttttctgaaatcagtattcaaatttcattttaatatgattataagtatataattttttttacatgaaagtatacaattatcttattttatatcaaacacaattttttaaaacaaattctattaacaattttcatatttaaataatttttttaaaaaactctcccaaataatttttagagacaatattgctcggtgcattgcacggatactctttctagtaaactaactataactttcattcttagtttattaacactacgtaattttcctgaaactgctgaaacccgttttgtgtttatatcattttctgatccttggttccattaatttttcatatatagttgtgtaagactgccagatttgtataagtacctcacataatatacatcaaacagcattttagatggtaacgttacaaagtccaacgtttaaacatatatgcgttggaaaacgtgagtgataaagaagaaaaatttgttgagatgaaaaaaaatgatttaaattacataaataacataagtaaataattgcatgaacaactttaaatcaaaataataaagataaaaagggtaaaaatgtgtttgaaatgaaagaggtaaaataaaaattaaaaaagtatagcattatgcctactttttttcatatcaaaagaaagataaatttttgcctttgtcaaattacaaattttaattctaactcatgtatctgggggagataaatgtatttttttttcaagtattttttaaattttataagaaaatttccttaaactgaagtaacattttctcgtcgtaattttttatacataaaaaacattatgctttattcttcaattaatagctgtagattatcctattaacaagttagaaaaagggttttaaaatattcaattttaatattataaaaacgacaatatacttctattataaattagtattttagcttatgtaatctataaatcaaatgcttatttttatatgattaaaattttataataaataatatttttgaatgtataagttttattatattattatgaattaaattttgtaataaataaatattttttttagatcaagaaacttatgtcatttccatcataagtaaatcagcaaaaaaccagggatagcaatttcaacacataatcttatatttccatttatattatttattataaattatgattataatcatatataaatatgaatatatatatatatatatatatatataagatgggatccgtttacaccggtgtaagaattaatagtcttacaccatttaataactttttactgaataaatattttataaaatacaccgttagattaaaagcttatattatgtagatcacatgtctcaaatttcatattaatccgaaatcatttgatatctaattgatatatataaaaattaacgtaatatgtacttctaaaatatgtgaaaattagactattcgattacattcatattgatgtttaaattttgtgaaatttgagacatgtgatctatatgatataaactttcaatcaaacggtggattttgtaaaatacttatccaataaaaagttattaaatggtataagatgtaaatggatctctcctctctctctctctctctctctctctctctctctctctctctctctctctctctctctctctctatatatatatatatatatatatatatatatatatatatactctatgcacagtagtgactaaagtactactaattattataaaaattaagcataataagaaatatttaacagtaacccggatcagaaactgcgaaaagtctctctctcttttttttctggtttgtttttgcagcaaaaaaacaaaaatcacaactctctattctgtttctcttttctagttatgttttgcagctgaagatatcaaaatcctatgaaaggagacaaagagagtgagagtggttgttgcagtggccgtccaagtttgaaactttagcatattcaaaacgagacccatcattaaaaattcagactttgatagtcctttcctctttgttctcattctcccatctttgtccgttctctcccgtcaacgttgggtttctctctctctctcctcagattttgaaatagaaagatgacgccggagaatgagaatgagaatgagaaggagaaggatcaggtggtccttgatgcagcagggatgaagaggtacaggaatggtgaaatctgggagtatgaggctgacatgcgtgtctcagatggtggcactggtgtcttgttgggcttggatggtggaaccacctccactgtctgcatttgcatgcccatgatacccttttctcactctcagctccaatctctccctatccttgcaagggctgttgctggatgctccaatcacaatagtgttgttggtaatttcataattgcctcttttctcttgcactcatagtgtttgatgatttcactttgtgggttggtttcaaaatttgatattgtttatgggtttgttgggttttagtatgtttagtgggtttgggcattttcaatgatttggttgtttgcattaacatcctggttggttcagtgtgagtatttttcaatttcctttctttgtgggttgggacaatgggaaggataacagagaccccttgatttggatatacatttgactttgcataccttaggaagatgttgcttatggcttttagacaatttggtgaacaaaacatatctggtactgaaggaagtaggtattttgttatattatgaagccaaatgttttattgatgtaaggtagtcaccggagattatggcctacaactaagctgttggagattgatggtttaggaaaagctgcaatcttatggtacttttttttggttggagttgttaaatgtctttaaaaagtacatacttgtgataggattttctaactggcattctgtaaattctatttggtaagtatttgacattttgaaattagaatgagatattgtttggaatgtaacaaagctttctgtagaacatccactaaaattatggctccagacatcaataatcaattttcaaatgttctttaaatatgataatcaatttttaacatctttggtttatggcacaacaggtggagcctgctgttggtgcggcatggttagcttggaattttttaatgaaagaatgtcacaaaggctgacaattgatgaaagtggaatatgagaggaaaaaataaaaatggaaagaaaaagataaacgacaacttacaattcttgatgattaaaagtgtatattacataatgacgaaagtgtgaatacctatgatatgccatgtagtttatgtaccatccaaaatctgtttattttagttcatggcacatggtaaggcttagttccccccttcactaccttaaggtcatatacctatgcttgtgtaaataatttatagtggcacaaaacacaatagagaagtgtcttaattgtcgtataactgctatttttttaattatcattaattgttgttagagaatcaatattaacaatttggcacagttaatggaagcgtgtataatgtaattaacgtggctttatgttaatgttgttttttattaagaaaaacatgagttccatattggctaaagaaaagatcgagaaatagtatataaggaagggataattttcactttatgagctaattttttaagttgaattatatttaaattcatattctaagatgatattagaatctatactatatctatttaaatagtcatacgagtttatcctatatctatttaaagagtcatctactatgttatttaaattcatgagctaatttttagagttgagctatatttaaactcatattctaagatgatattataatatatcttatattcatttaaagagtgatgagtctattctatatttatttaaagagtcatctattatgttttttacgcataaatttaagctaaatttactttagttaaaatttgttttaaactagtttctatttatttgaaaagaaattacttaaatataaaatgttgtcatgtttactgaaatggttattagaatgtacttcctgcagttaagtattgtttgataatcatcaaatttatgtgaaagatcgtacgggataacaaaaaagaatggagtgcgaaagaaattggaatagaaaaaaatactttcattatttttaataaagtttatcttcagattaattttaacatttggttttgaaaactttattttcaaaaactatattttaagaaaaggcaccctgaaatattagaattttagaaatttctaaacctcataacaacacaagttattcagaaaataataatatttaacaacttaaaatgtattaaatatatactagcattttaaaacattaactttttattaaaaaaatccaaagatgtcggggttactttacgttaaatcatcccatctagtaatgaatgaaatttttttagcactctgactaaaccccatgaaatgagttactttagattaaatcattccgtcagacaatattatcattctaaaaaagtattaaaaaatataaaaatatgaatttaataatgcaaaaatttctaatccaaaacacaagtttgaaatcttttaaatccgactgggttgtactttttcagtgctacagcgtgtttgatttgatgttgagaaattaattctgaatatattttcatatatttaattttatgttagagaaaaattcaaaattaattctgggtcaaaataattttgagtgttgatccaaaatttggtattgaattttacttctaacctacaacaaaacatacaaacataaatcatatcatttcaaaattaattttaaacaatatcaattttacaaaattaattttattacaacgctcatacaggcaaatactaagaaattcctcgcctacatttacccttcgttaaatgacaggaaagaaaaagaaaaagaaaaacagatttttaaaatttaagctggaaaaataatttgaaaaaaaaatggaatttttaaaagtcaatagtttctactttccctccaatcttcaaccaaataatgaaacttataaaatttctacaattctttcctcctatttttctctcacgtgcagggttaattctcataatgctccttcagctacctcttgctgtttttttctttttataaacatttcattacttccttgtggatcaacgaaatctagcaactgttaggcaaaatacgaacaccgggaaaggcaggatttaaacaacgtgattcccaaattatttaatcaaaccccttatgtaacccagggtgaaggggcgaaaaacaaatatttgataaccaaaattacatagtagatgagaattttcttgcataataaatttttagtataaaataaaacagcaaagcaccctacactacaggttaccaagacatttgatcttcccttaactactactactataaggaacataaatataaatacagctgcctctttaaaactgcccgtgctgatgttgcccatagagacaagtaatgagccatggcagatgatggaacccgcagaatacagccctcccttttttctcctttttataaatgtttcaaaaagaacatacacagctgagactgagccaaaagtcccagaaaagaaaagaaggccgtagaacttctgtcttctaaaatccttagtaatacaaggattagccaagaaacctgtaagttttagaggaaatgacagacgcaaactctacaagaactaagccaccataaataaggatggtgcatttttttatatttatgttaattaagttaaaaaggtcttctattgttctgattactaccacgagaaccaccaaagccactaggctcacctgagccaaaatctccaaaaccacccgaacgatctgaaccaccaaatcccccaaaatcatctgggcgaccaaacctagacccactggatgatccgccagatctacttcctgattgacctgaaccgaagccaccagatgatccaaaacgaccagagcttggtccaccatatctattcatttcaccagatgaattaccagaaccaaaacgattataattctgtccaccaaacctttcaccggaatttccaaagctagagcggccagaaccagggttactgtagcccccagaacggccagatccaaaacccgtatcaccatatcgacgatccctggtacctccgaaagaaccaaatcgcccaccacccatgccaccacccatggccactgatgcactatcaacagcaatccgtggtagctgataaacacaaatataggaataaaaagcaatcaattaatcattataaataaataaaaaatactgtcctataatgtaattagcatagagcaaacatcacagtataaaaaaaaaaaaaaaacagtagtaataagtaataactgtaggatagtagttcacaggcagcttagatatacaagagtactaaagaaaattaagattttcagtaactcaagttttaccagtattagttgcaacctgccaacctgactcgcaaactaataataaactatttcggcaagtctctacatgggaactctaattgttcaacatcaactgctttaacttgggattccacaggtttaaatctcattgtgcacagtaaggatgggatttaaggcaggaggttgtgttatccttgttagtaattaaaaatagattatcctcaatttcaatcacgagaaaattactaattaacaagctacaatttccagtaaaaagggcagaaattgataggatgccaggagatcacctctgtaaatctactgcccacatcacgctcaataagcttaacagccctcgattgatcttctgtatacaccagaatagcagttcctttcttaccagcacgacctgttcgtccagaacgatgaacaaatatctctgaattgttgggaagatcataatgtattacctatagaaggaaaccaagttaaaacttcacatataaaaaattgaataacatggtaataatattttctatatgaaagtatttgcatatgcacatgacatgttaaacaaagtaaagcatagaatattgataaagaccgcaaaatacaaaacaataacacatcaagcaacaaaataaaatctgaggtccaaaatttatagaaccacggacagaacagtggcaagaatacacctaaagtattgctcgattgctaaaaagtaagaacggacatttaaagctctgaaagcagataagaatgaacgatcagatgctaaaatatgttgttctatatggaaacatacctaataatatcatcaatacacagaaagcatacagcccatcttttgaaaatgcatcatttgttttgtaaagcaaatttgctcaaaaaattaagaggaaatgcagcatcataaatatcagaagctattcattgatttcaacaacatactagctatggccagaacatctgatgaaaataaatacaagtcggaaatgtagagaatcccactctaaaaattagagaaaattctaaaaagtaatcaatcagagacaagtgagttatcatatgcgtaccttgtccttacataagtaattaatatctcagatacattgagaagaaaacggtaataataactgataagcagcataaaaacccatggaaaaataagagttttcttgcaattcaattaacaataaacacaattccaatgggtcagccaacttaactatttcaaagaaataaaacaactcacaagatcaacattaggtatatcaagcccacgtgaggcaacatcagttgccactaaaacattgaaatggccatttctgaagccagcaagagttttctccctctgagcttgtgatatgtctccatgcaaagcctcacatttaacacttcttgccatggtatatgataatcgatcagcatcacgttttgtttgagtgaaaacaatacactttcctccttttgcatgttcctaacaaaggatatatctttaggagagacaaaaaaaaatccagcaagaagtttccttaactagcttttctaaataaaaatagggtttactatcattttagtccctaaactttttaggatttttgttttcagtcctgaattttttttttctactgatcaacatccattgacttttttctgtccttacttttagtcacttaacatttttccatccttatttttactaaaagtcggaacggaaaaaaaaaaattgagggactaaaagcagtaaaaaaatgttcagggattaaaaacagaaatcctataaagtttaggaactaaaaagatagtaaacccttaaaaacatataaaagggtgacccagtgcacaaggctatacctaattgggtctaaggagcgtagatgtacacagccttaccacctcaagcgaaaaggctgtttctagaatttgtacctgtgaccttcgagtcaaggcgccaaccctaccattgggccaagactcacccctaaaaactatggaaaataacaatttttttcaaaacctacttcttatgaaacagaaatgatagtaacaatcgttaatcagaagaactagcgatcaagaaatgatggtttcagaaggcatacggttattagaggtgaaagaattcccgctttaacatacaaatcagttgcaatggagtacagtgaaattccatctgccaacttctgatcagaatctccaacctacagcaccaataagtttccaattaaaaagtaactatcatgtgctcacttgcgcatacatgcacaaaccatatgtacatttagatattataaacttatttctcaatgaggttcatgtgccctacaacttaatatactaggtggtgtttctacattatatttttttagaggagtcatattccagttaaataaacgatatctcggaattgcaacagcttaaaggcattctccaatagcctaaaatagaatttcatactcacaagatcaatggtcaggggattattcaggtaattgcgtgaaatctgctttatccaagatggcattgttgcagagaacataagagtctgacgttttgggggcaacctctccaagatcttctccacgtcttcctgaaagcccacctgaagcatctgatcagcttcatcaagaacaacaaactgaacatccttcaaatttagagcacctctgttgagaaggtcaataatccgaccaggtgttcccacagcaatatcaaccccataatcaagttgcctcatctgccgagagatgggtgtacccccataaacacaaattgtatccaaattaggtgccgattcacagaactccgcttcaacctgtcgagcaagctctctggtcggagccaaaaccaaagccaaaggatccctcccccgcctgccacatcaaccacaaaaaaacttgtacagttaaaaaacaaatcaaggttttccatgattccatccacaccaatatcaattgcatagtccacctttaactcacgcagagaaaaagttacaaattcaagtaatagcgaaacataagcatgacgatatcattaaaaaaaaaaaatagaactaacccatgcttagcattaaactgaatgaccttatccatgatgggtatcccaaaagcaagagtcttcccagttccagttctagctcgaccaatcatatcacgaccttgcatagcaggttccaacacagccctctacaatttaacaaaataattaattaattaaaaaattaacagaagctcaaagttactaaacatctaaagtctaaactacacagggttaattatcaaccatggatcatattatgcaccgacgagtaaaccctaggaagcaaagcaaacctgaatagggaagagcttggtgatgcctttcttggccaaagcggagactatatcctcagaaattccgagcttcgcgatctcgaggccttcgtcagcggcgttccctttggagctttcttcgtaagggaaatcgtcgacggcatattctgcgcgatgacatgaagaggagcggaaattcaaggggccagcgttagagtggaaggttctggaattgaaggccgcggagggtggccggaagtggtttccgacggtggcggtggaggtggaggcggagattaaggcggcggggaaaccgcgccttgagagagtggaacaggttcttctgaggattgcggttaacatggtgtggtgagaaaatggaaacggaaaccctaaacactacaattcggggtttagggttttatgagaatagaatatggaaatggaggagatatttggcgggtgggacaatcttctgtatgcgagtcttcttactgctcccgtgcgcctattgcattttttttcagatgaatttgtggctcttgatttatttatttttaaattagtctcctaatttaaaataataatagtactaatttttcttatttatttaattcaaaacatgttaattctttcaacaaaatttatcattttcttagcactatttgaacttttttcaatttattcaagagatgaaacttatttcattaaacttatttatataaaagcatcgagaaccaaaatcatgtgaaaaataaatctcagtgagcaatcaaaaaataatatgatattaatttttaaaaaaaattattcatgaaactcatttttcatgtaattttcattttctttacatctaattttggttcgaacattagttggttttcatatttttcttataaatgattctgataagacaaatttcatgttttaatttaataaaaaatgcttaaataggatttttggttcatatataatataattattttgattttgatcatttatcctttaatttttttattttattgtaggctatgtaaaatttaatacttttgattttaatctttatagttaaataacaatattaactaatgacataataataatatttgtagtccaataaatttagaaatatgacatgccattcactatgttttcacaacaattgatgttgcaatacagaatattgtggtgagtcgcacactcctaaatacacaatacacaatggaaacatgtttaatcaaaagtattttcattaaaaaaaaaaaaaaatcaacaataatagtgtatggacttagctatacagggtgcgaataacaaaggccatcactagacccaataatccgtaatcgcctcacatctagcccactaaacagcagtgaaaatgaagttattattatatataaaaaaaacaatcctcacatttcaatgaaacatatggactataatcttctaaaaaaatgctagaatatatttcatcttgatgaatattggtagaggtttcacgaccttcgtttgtaacagtaaatgtctaatttgattttcaaaaattcactcaaaataattcggatcatcatgcatgtcccctgacattattaattccttagagaaaatgcacgataataacttataagtgttttttaacctcaaaaatatttgtctcactttaaaaaatcaaaaccacacacacatataataataatatgtcccattttaaatatgtgaaaattataattttaaaatatactattagagaaatactaatcacgcattttacattagatcgtattagattcggatttttaaattaagcataaataattcttgtgaaatttaaaggacttggaaaaatgtaataacttatataattttctttaaaaaaaattatgatgaagattttatagtttgaattttaaaagatttatatcattaaattttaagatttaaaagaatcttataaatttataagattttaaaaaaattatgaatatttaaaaaatattcaaacttaaaactagtctataaaaaaatctaacaatatttaacacagttgacaaataattttttttctaaagaatgtcaataggatttgattttaatatcattatgtatgtctttcttatttaattattgtggagcatgtatacatattctttcatatcgttatatattaccaagaaaaatatactattaaaaagtgaaatgattaagcttgtaatcatattttattgaaagtaagagtattaatagaagataaaaagttattgattataaatgtatagataaaattgaaaaacaattatgtagcttctaatttataagttaaatgacaaattttaagttagtaacatgtggttttagtttttaaaaatatcttaaaatttcattttagtctcacaaatttaaaatatcttgttctggtctattgtttctagaaacaatattgttaacaaaaaatacttttaaataatcatattttagtttttaattaatttttaactcttataattttttcaaaatattttattaaaatataagtaaattatgtaaataatggaataattaaaatgaacagtataatgttaatttttttaataaaacaatattatattgtaggagacaatatatgagagcttttaataagtaatttactcataaaaatctatccagattaaactattttttttcaatcatcggctaaagtaagaattaaggtttaaatatatctttagtctagcattttttttattcatctaagtttacttttataaatttaatctctaaaaaattgtgtttttaaattttttgtctctataagatattttacttatttttaattcatgtaagtttacattttttaaaattttggactctatgagaatgaatttatgaagactataaattaaaatactagaatctgaaggtcaaaaggactaaaattgaaaaaaattatattataagaactaaaatcaaacaaaaaaaaacttacaagaaataaaattgaaaagacgtcaacttacaaaaattaaaattaaaaaaataaacttacaaaatcaaaaattaaaaaatgtcaacttacaagcaccaaaaacatatttaagccaataattaataaagctttgcaaagtttagtcatgaaactacaagttaaaaaaggtttaagaaatgagtttaatgctcatgcaatggcggtatgaatcaattttgcattgtcattcaatcatcaatcgttgtttgaattactttaagataattattatcatacacgatagattgtgatttgatgactgtaaaaaaaaattacactgtcaatgcataacatttttttcattgaagaaattgggtaaaatagtatggggtttaagaaaaaaaatgcttatgaacatattcaacccaaaactatttaaccaaactaattaaactctgatccataaatacatcatgaaaaataagtattgggttcattatgatatccaaattcttgttaagttggaatgaaactatctttgtcatagataaacttgtttactttagtcaaataaacttataatcttgccaaataagttataaattactaaactagttaaaattgtttatgaaagatgtaacatttttgtgtaattatatgtattcgtgttttaaagtatgtaaatcacactatgactttatttgatagaaaaaaattagagaggatatgaagagatgaaaataagtggtttgtttggtagatatgattagggtggaaacatttataaaaattgttgaactcacttgtactattttgactcatttttctatttttctcttcatttattttctattatcttcaaccaatacctttaatttttattttgcttctcacgtatttcaattcattcatttttttccatctagtatttcatatttttttctgtttacgaaacaaggtgtaaggatgtgttttgatacataccaaagtataccataaggaaaacaacacaaaacaaacatttaagttatatgacaagttttttcctttgcattgtttgtggatattggattacatagtcaaaataatgtgaaatttactatattgccctttttaacattaattatcttaatacaattcatattaataatctattcatcttaatacggatcaaataaatattaatgatcttaaagatgattgtgatagtaatggcaattggggtaacaatgacgacaaatggtgttggcaataacaacaatggtggtgtgatgcgttgcatttagtctttaattatgaagcattttagttaggattgcttgctttattggttgtttaggtctttgttttttgtttattgcattgcattttattcttttttgttgaacttgttacgtcgtgggtgttttcatgtgtacaggagccatgttgacttggcctttggtgctaaatggatctttcctagtgcatgttggacttttaggatcaaacttgtccatcaaggacctttttggaaggaaaatatagctatttgtgaatggctccatctggcacgagtgtgccaagtccattatgtcgcaatcaagcttttatgcatctagcacgaacgtgtcatttagtggcatgtgcgtgccaagccctttatttcttgatcaggttgttgacacatttggcacgagtatgtcatttagttgacgacttattttcttatttttgtgctttttagtgtatttggtctgaacaaattttagtttgtctttaaataacttataaaaactttgtagaagggttttgacttagagattaacgacttaaatgagcttttgattttccttggcttttcttttctcgatcaatactttgtagcccatgttcctgatgatcaagtttaatcctgaaaatccaacatgcactagaaaagattcatttagcattgaaggtaaagtcaacatggcttttgtaacatgaaaacacccacaacataacaagttcgacaaaagaataaaatgcaatgcaatgaacaaaaaaatagacctaaacaaccaataatgcaaataatcctaactaaaatgcttcccacttaaaagactaaatgtaacatgtaacaccccgtgtgcacccggtgtattatcattgtataatagtcagattagcgcttaatcagagttaattaaaacctttttaaaatatagcggaagcataaaaccaaaccatatttcttgattacattatgtatggaaagcaacccacatcaagcatcaacaagcccctgcttaaccagatcatacaaccaaaccataggcagataacacagatatctcaatgatataaacaggaggaagcatacacatatctaacataactggttatatacaacatcatctgacacccgaggtgtctacaaaagaataagcgtccaacgctttccgatcccgaggatccttcctcacacgagggcatacatatatataacaaaatacaactcaaacacatgtgcatacacatgtcttccctctacagggtacaaaacacaaccaaaagccgagacgagctccaagctatccactgctgcccaaggccaagcaggtaccgtctctactggagcctcctgccctgagactgcccctctctgccagaaacatcacctgaaaagcataagccccacacggggtgagataaacatctcagtaagctcagggtccttggaggcatctcctccaccctggctcactcaccatgacacacgtcatcagggtatcacaaccatctgggcctcccggcctctcataacaacacaagcaagctatctagctctatgtatggcggaccgagtcaaacgccgacctcagtgtgaaaccggaattcacacccgtgccatcccatcgggtgctaaccctttacgcatggacgcacgtatatggtacctccgagaataggcaatcaaccgcgacgggacacacctatctcttggtcttagggaatctccgcatcccgggaccgagtcaaccatgagcaaaccaaactaggagttgcgctctctcctagggaggtccatatctatcttaactggccagaagatctatcaacaggtatcatacacgtacaagcatagatacaggcatacatatcattatgagtaatgcaacaaccatcaatgcatgcatcatgaatgcgaccatcactccctcggagtatggtggaacacagcaagtgggaaacatccccaagggaccaagaacttacctggcaaagccgagctctgcagttcttccctcgctctgtggcccacgccactgacacccgcggtgtcacgccctatacaaggcacatacaacataggtatcatcaacattctatccgtacaaggcatatatctctagtaaaacatacggaaaagcataaattgctgcataaaaattctgcagattttacacccacttggaaaaatcataaatccttgtgggaagctcctaaaatcacgagaatttagaggcatcaagatttgtctcttatcttttaaaccaaactggtttcatcaaaaaccatgaaccacagcctctgcagcaagccaaaaatcagaactgtcacacaccaaaatagtgctgacagcaacagaccaactcaagcagccatctttcgaggactacccacaccaggttacccatccaaatgagctgatattttacaggcataaatttcacatacccatcttactatagccactggaatcactcgatttggatcatcctagacaaagttatgctttctgcaaaatggccctctgcagcagaaaaatctgctaaaaacagagtataacagcctgttataactctgcaccataatttctaggagactccaaaaatagcacgaaaattctagagccaacctaactctcttagctttcaaatggcactggtttcataccatttgggcaccgatagcccctgttatgggcaaaacaccagaactgcccaaataggtgtccttagctgtcatgaacttgcatgcttgatttaagcatggaacaccatttcaacttaaaaacaacttctacccactccaaaacacacatcaaaactgtctcaccctcctaaaactcagcatacaataatctcactccaaccctaaccctaacctcaagaataaaggagaaataagaggagatttcaaaccttagagttcaatacaccaaaatagagggtagaccagcactctacggcttccaatcacggttcagcgacgccgaacgagaatgggcagattcaaaatccactcttctctccaaatcaccaacacccaaagctcaaacacaacaaggaacaaagaagagggctttctttctcacttgttttgtgatttcaaccactaatcacgtgaaaacggcaagaagagagcttgggagtggagagaaaatcagaggagaagaaaagagaaggagagaatagcagaaaacgtattctgctggtttttaataagaaaaaggggtgcgtccagcaactactaactgcacccgtacccctaacaaagaccaaactgccctttcgtgaattccgtttagttacacaattaacatccaaattgccttaattaaatttagtgatattacataacacatcaaacaaccccaaacttagagatttgtttgtcctcaagcaattatcattagcaaaagtttttaataaaaagattcatcatatcataactcaagtataagaaaaagcaacatataaccattattacgcaaataatcaaataaagtccaattagaggctcatcctccaaaactaataattgcaaagacaagttcactcatctcacttcactaaggtgttttaggataaaatcctttttacttaacttctcaatgcaaagtgccctactatagtttgggtatagaacctcatctccactagtaaccaaataaacacaagcaaatcacaaggtctttaaagagatgtaattgagttagaggttataatgacaaggtaagaaaatcaaagaaaaggaaaaataaaggactcttatgtcatctcaataccccataaagtttagacattaggcaatatcacaagcagcatttccaatgttacatttttttagttcaattccatgcttgccaaattcaattattgttctcatttttttctcttaatttttttttctttctattttcaaacttgattttttagagcatttaacatttgttttttcagtaagaataatttataatttactcataattcctcctttttcacatatttagccaccaagttgtcacatttttaattatggtaacgatgatggcgtaatggtgacaccaattgtgatgattctaacgagggtaatgataacaacaataacaataaaattggtaatgacatgaatgatgatgataacaatggtaggggtggtgatgacaatgataatgttataaataacgataatagtaacaataatgatattgaaaatgatgtcaactataatgatgagtatgatagtaatgatgatgacgatgatgaaggtgataacaacgattatagtgggagaaagaaaatataattatcaaattatgaataaaaatgattatttttgcttgttgaagattttgtacttggaacaataaattgtcccatagcttaggaaataacaaaaaaataatttttttccttgtgtccatcgtatgtaatttgtcataccctaattcaaaatttaaaatcttaaacgtgttatctagcgtgactagctgagctggtacacgcaaatctccatctatagacagagggctcgtaaactaggaatcttagatgggacaaataagatttctctgcatatcaatatcgctgccattatttagcttctgcgtccgtagtggccagtgccacgatccctttgctcagtgggtgagatcagataaacatgaggtgcgtgaaaggaaggtctaaatgtgatttttcaatttagacccgtacccagtgctgtttttgctccttatatataaataacaattattcatatgtattattatcccattgcacagcagcacaggttagactagaccactttggaatttattatacattatatgatgccacgaaccttacccaattggaaccaagattaggacaaccatcttccaaatcttcaactgaagcagaaagtgtacctaaactaaagtacttgtttttagtggcttaatgctagaaatgggtcctaactccactaccccaaaacaaaacaaggaattcccagaaatgggaccagcatgttttccaatcactctgaggccccaactgtcatgccttcaatttcaaccatagcaccctcccaatattagcttcccctgccatccaattggtcatcaaaatacaattatggtaaaaagaaagattcaaactggtccacattttgtagcgagaaatttacatttttgaagagatcaatatgatggatcccaacatggtctcaaaagaagaatcgatgcctttgccttttctttttcacgttagggtgtaaagcgaaagggttaaaagaggctgcgaggctccttgtagaacactgtaccttttaaaattattataattattacagtttaacaaacatacattgtaaagtttttcttttattaataatgattgacacaaatgataatgatttatatctcttaattcaatggttcataattcaaatctctaccttgatataaaataaacattgtactaataactagttagaaaaaaatcaatatataagtttttatattgttaatcaataaaaaattatttttaatataattttaaaaataattattataaaaattaacaaatttatcatcttagttattagttcatgagtacatgataatgtaaaaaatatttatattttttattattattatacgatatatagcaatgtactttattcttactgggggaaactaaatacaaagaaagaaaggggtccaggggaccaatggtatccacctaaaaagaaattaaactgttggagtttatgagctgacctaggttgctttcttgcatcctcatgtcctcattattaaatcatgaagattgtctcgttcattacatctatacctggtctgagttggctgccactcaattcatatacatcaatttttcttttcctattttcattttcatttttttggggaggggctgactaggattgggaagtgggaactaagatttactttctcaaaaccccagaaagagaaaattgaacatatgtttctaagatttactttctcagttcagcaattgggatctaacatgtattgattggtatgttgatggcctgatcctgatggtgccaagttctttaaaattacattttgatgtggctggatcaaccatatcatatactttaaatttcattcccttttcctttttcatctgtcttttttttttctttcttccttttaaatcattcgtgacggaatttgcggagaaggacctcgatcgattttaaaagatgattcctaacttcatcttctgattgagcataacaaacatgaaaacaactttttttctttatgattccttgattttaaattaatgatgcgctaaataaacttttggacatgccaaagtgaacacgtgcttctttaatgtgttctgattactaacatgaattgataccctgataattgttttctcttttcatataagcatgaaccgtgttatgaaacatcaatggtatttcgaattggctgaataaagctagccatatctaatattcatgttgctcagaaatttctttctccttctatgcataaagctagccatatctaatactcatccatgcaatgttatttctttatctattttcatcacatcaactattttatcacgccattcttgtacacagagaaattatataaatacaatttctgttagtctcttagagatatgccttttttctaaaaatcattcaggtgtccttattcaataatttaagcctatgaaatgaaatagatgatttatgacatatagtacggtagcttctatgaccatatatatatatatatagagagagagagagagagaggttaatcgttgttatttctcatttattaaaacaaaaattaagttccattcatgacacccccaccacattctctttttcaaaatccagaaattaataaaaaaagaaaggtacactcagcatgcacattgtatcaatttattctcccccatgattggtatctataatatggtctacgattatatccccatcatccaaatctgattcatcagctgctctggtggaattggtttatgaataaacaaaaaaagaaaaacaaagaaagaaataaaaagctaaaggaagtggtgcttctaggctcaaaaaccgacagaatacaaataaaatgaataaataaataaataaataaataaaatttaactgggttgtgaaacggtccgtggttaagcattttctatccaaacaccgcttttgctttttaaaagctagagatgacaccaaagtagtgtgtgtatgtatgtttgtgtgctgagaaaagaagagagggaaaagagaagaggacataggatgctgtaacactgttacctctgagctcttaacattacaacacataacactcctcacacactctctctctctcttaccacctgctacttcatattcagcataactctatgatattgttgttattattccaactgcatatccttaacttctaagctagttaatcccaaaaatgggaactgtaactcttggccttgtacttgtactcctccttttgtggttaacttggcctgcttctgtttcttctcttcccatgtctttgagaaggcaagcctctatcttggtttctctcaaacaagactttgaggccaacaccgattctttgagaagctggaacatgtctaactacatgtccctttgcagtacctgggagggtattcagtgtgaccaaaagaataggtcagtggtgtcattggacatatccaacttcaacatttctggcacactttcaccttccatcacaggactaaggagccttgtgagtgtttcacttgctggtaatggcttctcaggagggttccctagtgaaattcacaagctagaattgctgagattcctcaacatatccggcaacacgttcagtggagacatgagatggaaattttctcagttgagagagcttgaagtgcttgatgcttatgacaatgagttcaattgctccctccctcttggtgtcactcagctccccaagctcaatagcttgaattttggcgggaactatttctttggtgaaatccctccaagctatggagacatggttcagctcaactttctgtttcttgcaggaaatgatttgaggggtctcataccacctgagcttgggaatctcactaacctgagacagcttttcttgggatactacaatcagtttgatggtggaatccctcctgagtttggtaagttggttagtttaactcaagttgaccttgcaaactgtggcttgacaggtccaattccagctgagttgggaaacctcattaaactagacactctcttcttgcaaactaaccagctcagtggctcaatccctccccaattaggcaacatgagtagcctgaagtgtcttgatttgtcaaacaatgagctcacaggagacatccctaatgagttctcaggccttcatgagctcaccctcttgaacttgttcatcaacaggttgcatggtgaaattccacctttcattgctgagctgcctaacttggaagtgctgaagctttggcagaacaacttcacaggtgccattccatcaaggcttggccagaatggcaaattggctgagcttgacctgtcaacaaacaaggtcactggattggtgcctaaatctctatgccttgggaggaggctgaggattttgatcctgctcaacaattttctctttggatctttgcctgctgatcttggccaatgctacacactccaaagagttcgtttgggacagaactatttgacaggatcaataccgaatggttttctttacttgcctgagttggcccttttggaattgcagaacaattacctcagtggttggcttccacaacaaacaagcactgcaccctctaaacttggacagttgaatctatccaacaatcgcctatccggctctctaccaatttccattggaaactttcccaacttgcaaattctggtgcttcatggaaatagattctcaggagaaatccctccagatatagggaggctgaaaaatatactcaagttggatatgagtgtcaacaattttaaaggtagtattcctcccgagataagtaactgtttgttgctcacctatttagatttgagccaaaaccaactatcaggccctatcccagttcagctttctcaaatccacataatgaactatctcaatgtctcatggaaccacctaagccaaagtcttcccaaggaacttggggccatgaagggcttgacttcagcagatttttctcacaatgacttctctggttcaatacctgaggaggggcaattctcagtgtttaactctacatcctttgtgggaaatcctcagctctgtggatatgagctgaatccatgtaaacactcttcaaatgcagtattggagtcacaagacagtggcagtgcaagacctggagttcctgggaagtataagcttctctttgcagtggcactgttggcttgttcattggcatttgcaacattggcctttatcaagagcagaaagcaaagaaggcactccaattcatggaagctcacaacatttcagaatctggaatttggaagtgaagacatcatacggtgcataaaggaaagcaatgccataggaaggggtggagctggggttgtataccatggaacaatgccaaatggagagcaagtagctgtgaagaagctcttgggaatcaacaaaggatgttctcatgataatggcctctcagcagaaataaggacactgggaagaatcaggcacaggtacattgtgaggttgctggcattttgttcaaatagagaaaccaatttgcttgtttatgagtacatgccaaatggaagcttaggtgaagtcttgcatgggaagaggggagagtttctaaagtgggatactaggctgaaaattgcaacagaagctgcaaaagggctttgctatttgcaccatgattgttcccctctgataatccacagagatgtgaagtcaaacaacatattattgaactctgaatttgaggctcatgttgctgattttggacttgccaagttcttgcaagatactgggacatcagagtgcatgtcttccattgctggttcctatggttacattgctccaggtacttagttttaatatttaaatatataaatcaattagtctacaatatgataactacttctagtagatttatattggttacatgcaccctaacttccaagtttaggagacattgttgcttggctccccaaaaaaggttgaccaagtgaaatgattgaggtcaaggcctcaagggttttatttttatttttatgcacaatgacaacagttaagtttgaacttagaatattgtgcaaattatccaaaattttcactactaggccaactgcagtgggttgggttaataaggtcaagggatatcaacagagatgattatttcaggtccatttaacaatcaaatattcatagtaaaaaagtcaatgggaatagaagaattaatatactattctgttttttgttagcacaaaaatattttatttattttccctgcatgtacgtgaatttctagatcggtcgaaggctccactaacacaggaaaattctttcaatcttttgcttttcctcaccttaactgggtttgtgcttatgccttgaaaccataaacccgtatacaaaccaaagccaaccacaaccatccttttttgactaacatatctataagagccaccaaaagcatatgcttctttcatcaaggcaccagattgagatctatttactttctccaaaccccagaaaaagaaaattgaacaatttacaggcacaaggcaccactaacttgtcttcttacaaatttaattggttaacttgaaaattaaaaataaagcttttcccttgtttgtttataaaactattaattagccagtcttttacatcatcatcatcatcatcatcatcaacatcatcatcatcatcatcatcatcatcatcattatattatatactcaaactcttttttcctcaacaatgacatttatagtactgtcatatataggcataggtactttaacttttgagctaaaatgtgaaagccaacaattatggtgtactgattttgattcatatatcacagaatatgcatacacattgaaagttgatgagaaaagtgatgtctatagctttggagtggtgctgctagaattactaacagggagaaggccagtggggaattttggtgaagaaggtctagacattgttcaatggaccaagttgcaaacaaattggagcaaagacaaagtggtgaagattctagatgagaggctatgtcacattcccttagatgaagcaaagcagatattctttgtggccatgctatgtgttcaggaacaaagtgtggagagaccaactatgagggaagtggttgaaatgcttgcacaagcaaagcaaccaaacgcattccaaaagcagtgatctactaccaaagaaccaaaggaaaagttaaagaacaaataaaagaaaaagccgactctatacatgtgccttgcatgtgttaatgttgtcggttggtaaagatgtcaattttcctaactagtttgtcatttgagttttaaaggttttctttttctttttctctttattaacacttagttgtgagaacaagagacttgcatatgttgtaggcatactggaaaatttactatagttggacaatgatgctaaaggggaaagggaattaatgttgatagtacctcaggagtctgtacaatatatgggggttggagttagattccttggttttcgtttactacttgcttgtaatattctaggaaatatttatcacctgcataatgaaatctaggagatgtcatatcagagtacatttttctttttccctctgctttatcataattcaagtgattttggtagggtatgctaaaattttagaaaatagattttgcatattgtgacataatttaacagtagcatgtaaaggttttaaattacagtcatgattgttttgtaattttgtcgaaatttttatgttgtgaatttttttagacaaatacgactaacggagctacaattactgttgcattgcaattgtgaagacttcataaaccttaacattgtagtaaaaattgcaattatggactatttttcaaaaccttgaacaatcacacaatttaattaagaaacaacagggtaaataaaatagttttatactgtaattttacaagttatcgtttgcatatttttaagataatttttaaaaatttaataaatttatcataaatgataaactatgattcaacgaacgataatgtaaatcaatacataatcttttttctcattaaaaaatatcttaagatttgttttatttgaatcaattttataatcttgatgcatcaccataaagagagaaaaaaaaattctatacatgatgactaggaataattagtcactaactaggatttatcacaattataaatgttacattatttaatgtgacgataattttatggtcgaattagattggaagaggacttgcattgatagagctgctaatttcaggtaatccaagtcatcatagtccaacatatttttacatcaagccaagttaatgacagaccaaattttttctaactcaacctagtcttggcatttgaattctgcactccatatgtttattatgcactttccaatttgtttgaaaataccaaacttactcccgcgatgacatctccttcacccgcaatgataacttcttctctcacgacttcaccttcttcacgacagtctcacaacctccatcccacgagtcacgacgccgcagaatgtcctcccccttctccttcctttgcgcatcaccatttaaggtaagaatgcaatctggaacatggtattttgtcttctgaaacaacaattttgtaatttttttattttcaaccattatgcgagagacatgattccagaagttatataatagccttacaaaatgaccatttcggaacatagattatttcagaataggctttccggaatacataaaatattttttactatattatgtaataggcatttcggaagttatgttttttactgttatgaaatacgtattttagaagacaaaactatttttaatgttataagatgccgggagctatttttttattgttatgaaacacctatttcaaaaggcagaaactattttttactgttataaaacatctatttcgaattttttttttattattataaaatacctattatggaaaagtataatatgaagaggatagtttgaaattttaaattttttgggaggtacatgaatcaaatcacccagggccggttctgggcccattcaaggggcccaaccgcacagggtcccaaaaaataagaggtcttaaatattaattactgtaacatatgttcaatattgaaaactaaaggagatggtaatgcctatttttaataatcaaggggtccaaggttcaattcccaccaacaataatttttactatttttaattatgattttaataattaattttaatatttttttatattttctctttaaagtgaattttataatttaaaagagttaaattcaatccatgaccttttaaaggaaacagtccataagaaaaaaatattattttactagttacttgacggccttgaagcccacaaagagttgcattgggtaattgcttcctgcatttccatttttgcttcctctacctcccaaaatgacctgatgctttgctattccggcccatttttctaagttaaccttcaacttttttaaacaaaaatacctttgatggaaatatgttgtcatatttatttttaaattgtatttcaatggtttaaaataattatcaaaaagaataaaattaacctttttttataatataatttatttagtataaatttaaaatataatttatatgttcaaaatatttgtttattatgaatttaaattataagctaatttataaatttaaaatatttatttatcttgtatattgtacaaaataaaatcctatctatcttaaagtaaacatttatttaatatgtttcacatactataatattaatattattttaacattaaatgaaaacataaatatatttaatgtgtaactgattgaacaatctaattaaaaattgttgagtaagtttttattatatatattaatttatccataattgtaattataaaatttactaaaataattttaaaaatatttcaacgttctttaaactaattgagataaactaaaaacatatataagttataataactagtcatttttttttgtaaggtttctgactgctttggaccctgtcgtgggtgatttgcgttgtaatgttttttccggtgaaagttaattgattatgggcctgggagctgttttgccctagcccattcagaataaaaaactcatctaaatatatccttgataaattgaaaatataaaattcttcacgattttttattttattttataataataaaatgaaaaattattccatttaaatgaatattaaaccacaattataaacttaatttgcatttttaatcttaaaatatgctcttatattatacacctgaatctcattagttttgtgagttatgctttaatgaaaatgtttttaggttatatttttaggaattctcttaaactaaaatgtttttagaagttaatatcattattctcatcgagtcacatgtttttttctttcttcatctcatgtattaattatccacccttacaatctataatttttatatttgttgaattaatttaggatgtatttttaggagttttcttaaataaaattacttttagaagttacgattactctggtcgagtcacatgtttttatttttaatctaataatatcttaattatctagctctttcaatttataatttttaaatttatttttaataattttaaagcaattgccagtagttaaaaaaaactgtataaaaattaaataatttatcgtaaatttgaaatctaaaatatttatttatgacacattttaattatagttttatatattttagaaatatttatttattataaattttaattttattatataaaaatgaatattgaactttacgattccgcaaactaggttgctaattaaaatttaaacattaacattttataaagaaaatatggttatatttaatttcttgcaaatattaaatacaattaatatttactataaaatttaagtaaactaataataaatagttataagaaaatttagaattattcagaaataaatacgaatttaccttaaccgtacaattcaatgaccacccaacatgatcgccacgtggactcgtatagttggttacactcaagagccaatgccaccatgactcatgaggcagcggaaattaaaagaattaaaaaaagataaaccaaagactgaaactctgaaagagtgtatataaaaacgtttctccaaattaattaaaaaaaaacgtttctccaaatataaaaaaaaaaacaaaaacttttttcctcacattattaatatatactattctccgtgtgtctctctctagagtaaaaaaaaaaaagggcaaacaaaaagactctcctccccctttcatctgaaaatcatcgtcgtttaatccaaatcgcttcgtcgtttaactctctaaatcggaagttaccacccgctgccaccgccaccgccgcgctcggcgaatctctccgccaccgccgcttcttcattcgaatctcgctccaccgcgattcctgaaacatcaactgattcctctgtcctttttactctctcttttctatacttttgatattcgtagctggcgattccgtttccggcgagtccttatcgaaggaagagcgctcacaattattaacctgcgcaccgtcacttgtcgcggttccttccgttcgaactaaattgccggaactctgttctgctatctgcacgtggaaaggtgagagtcgttcgctcgctcttgcttgcatcatcggcgcatggattcgctcattgcttagtgattcggtttcggaattagggttccgatttcggatttaggtcggttatttgttccgaaggtcgcgctctccaagccttaagggttttagtgacgagcttcgttcagtttgctgctcgatccgttgctttatccctttcgattcggttttgccgttgcttttcggagattaacttgtttttgatatgatgctgatggttttgtgcattgcacggtgttgaaattcgattttggcgaaatacgagtgttaacggaattcagttttgaccgttaaacttgacagtcgtttgaagcagtgcttacactccttgatcaatgtggttcattcgtgaacttaggataatgcatataggactgtttttaacctagaatttgaagttgaaaccgaatttgccatacctggtacaagttccgcttgaattgaacctggagcatggttttgttatttcatttcaacttgcacatctgctagagaatgtgtggaaataaatagcatgggaattttaactcacttgttaacctgtggtttgtaaaggaattgcaactctatggagtcactgatgattgaacacttgaacctgctaatttgtctactaagagctaagcatgtttggtggttttgtaagtatgtatttgtagaagtgttgcagaagatgtaaattggtttgatgcttttcctctacgtcttttctaacttgctggatggttgtaatacgggattctatgttgttatttatatcatcaatgtgtgatcaatggcatgagctgggcatcattcatgattctattgatcgtatatcactctttgtttttcaggtcttggggactggggagacagaagataactgaagcagcactggatttttgtcactttttttttttttttttatgattagttgcatccacagtgtggagattgaagtaaagataacagtaagttagtcatatgttacaggatggctttctttaggaacttttcaaatgatacagtctcacatggtgtcatggaagataaaagccaaggacagaatgctaatagagttcatagatcagtaggtaatgattgtactgatgcaacttctagtgagaaagaatttgatatgaacatggaggcacagtatgagagtgatggtgaaccagatggttccagtagactgcaaactgaggcaacagctgacgatggggatgctgtgaaagaatcaaacttgcagactactggtagtaaaacagctatggtcggaaggtggggttcaacattttggaaggactgtgggcaaatggaccctcaaaatggttctgaatctgggcaggaatcaaaaagtggatcagattatagaaatgcagatgggtctgaagataattcattggatggaagagtgggaagagtagactcagatgatgatgatgatggacaaaaggaggcaggaaaaggtccaagaggtcactctgatgttcctgctgaagagatgttgtctgatgagtattatgagcaggatggggaagagcaaagtgactcattgcattacggtgggatcaaaaagcccactggatcgaattcatggccacaacggatgtcgacctctgcaaatagaactttgcataggaattcaaggttttcagatgatgttgaagataatgatggtgaagatgatgatgatggtgatgatgctgattatgaagaagaggacgaagcagatggtatgtcgagcattttatttatataaagattgtttcttaagtatggagtactgcttttaaaatagctaatgtttggcctttattacatagttctgattagtgaagaacaactgtgattttttaatgttaacatcgtgcagaagatgatcctgacgatgcagactttgagcccgccacaagtgttcatgctggaaacaaggtcatttatttgtggttattgttgttgctgaattctatttcattaatggtcttttatctagtaagggcttgtatatgttcattagaggacaaattttgctttactgctagttttgacttttaaagttaatatgtcttggttttttggtggatgtttcctaataatatcaaatggtttaactgttgttattttacaggataaagattgggaaggtgaaggctcggatgaagatgatgacagtgacgaaaatatagttgtctcagatgatgatgaatctttctatgctaaaagacctaaaggaaggcaacgaggtaagattggacaaaacataaaatctaccagagatcgcaaagtgtatgctgcatcaggtcgacaaagaagggttaaatcatcttttgaagccaacgagtcaacaacggaggattctgacagtgatagtgatgaggatttcaaaagcacaaaaaagcggagtgttcatgtccgcaagaacaatggtcgctcatctgtagccacaggtttttctttgcgcaacagtgaggttcgcacttctagtaggacagttaggaaggtatcatatgttgaaagtgaagagagtgaagaagctgatgaagggaaaaagaaaaagtcccaaaaggtacaaccttcattatacacatctgggcatggtttctacctcctatcttttggggtttatttatctactaaaattgaatgttaaatattgattctcacatataagactcaaatcatcatgtcacttcggataacataccctccaaaggatgttttcacttgcatcgcaaatgactactggttagacatttttttcttcttattgattaaaaaaaattggtagtgtattattaggaagttgtgattttatttaacaaggataagttttacatatatttgatgacaaaaaaagatttatttattacaaagaagagagggaagtcactactccattgaaataatcattggatccgagcagcttatagtggagccaaaagcacaatcctaaatgaaattaagctgcagagtagagagacacccctaaagttgcaagtgtacagctccaaccaagtacatgaatgggttgcataaactgtgtagtgcccagaaattttcacctacttttcaccatcaccattttaaacctaacctgctaaaactgttccaaataaggatacatcaacaacaacaaagccttatcttactaggtgaaggttggctccaaattattaggatacatgaatgaccacaaaaaagttgtcccaatattttttatatctgtaactagtatcttatgtccatctacgcagcccttctaagatgtgtgttttatctgtttttgggggtgagtggatgtgagattgcatgatttgaagttcagattttttttttttttttttatcagcaaaattaaagttcagattaatgtttcgtaggaagtggaaggtatgattgaatgcacttaaaatctgaaaataatgtattttctattcctctgtttcagtttcaatgtgatgggaaaaaaaataaaaaatggaattatgttgtgatgaactgatgattgttgagttatctattattttggtgtttcttttaattttcattatttatagtatgaactatcgtgcgtaagagataggattattaaatttattgggtgttttactgaggagaattggaacaagtacactcaagtcttgttttaaatcgtcattcggaaaattgagaatttttaaggatataggaaaggaggtgatgttttttatcctttgtatattgtctttgagtgagagaaaagagaatgattactggcttgaagaaagcttatgaaattggatattttgttttgagtggtatatggccacttggtggagaccattagcttatgtttgtaatttgtgctagctgttctattctttacttttggtgtggtggtggtggagagatctcagttatgaggtttgctgattgcttgacggagttgatgctaaagatgcaagatggtaatttcagctgcattggttttgatgtttgagatttcccaatctatctctctggaaggataatagatttgttagagtacggagtggatatatgtcatttttttgtagacgccttctttaattctagtttattatatctatcaaaaggatcagtgtactttaatctagcaatgatgattttataaggctattaagctttttatattggaatggctttctggtgggagtatgagatgttagttatgctattatgatacctcctatttacttaatatatactttaaatttatttctactgatgtgattcttttaagtgttcttcaggaagaaatggaagaggacgatggtgactccattgaaaaggtgctctggcatcagccaaagggcatggctgaagatgctcaaaggaataatagatcaacagagcctgttttaatgagtcacttgtttgattcggaaattgattggaatgagatcgaatttttgataaaatggaaagggcagtcacatttgcactgtcagtggaaatcttttgctgagctgcaaaacgtatgatatttattcttattgtttattatgcattaatcattgttattctgttgttactgtctttcggtcagtctctgttttttattataacaatcctgcttcttattgtttggttgttttactctttcacatgttgagtttttttttttttttttttttttttttttttttttctggcctaaatttaatacattctgtctttatgtgagattgcagctcagtggttttaagaaggttttgaattatacaaagaaaataatggaagacatcaggtacaggaggacaatctcaagagaggaggtaattatttgagttcagccaatcaatttagatgctccagtttatttaataggtctggaggctataaatactgcagaagtttttgtggaaatttatttggtggaaatagtttatccggaaaagaacattgaaattatttatgttttttaataatttctttttttggttgttcctgtatgcagattgaggtaaatgatgttagtaaggagatggatctagatattatcaaacagaacagtcaggtttgctttcctgcattccaatattttcattactttggtcttgttttctctgatgtattgctatttgctaattggattgtttatttgcattttcaggtggaaagaataattgcagataggatcagcaaagataattctggcaatgttattccagaatacttggtcaagtggcaaggactatcttatgctgaagcgacttggtacactacgctaaaaatttagttatgatttacttatattttttgtttcattttctgtgaattgagtgtcttcatgttagagaggaggatggattgatctctaagcattgttgtacaccaagttttaaacttttagatctttatttagcaagtatgatatgatgttagttttctctgttataaggcatctattctgttttactgattctatgtaatttgtcactcttgatgtactagggaaaaggacattgatattgcttttgctcaacatgctattgatgagtataaggtaagtctctatttcactctattctcattattgtattggttttgaaaagttcggtatgtggttgtagtcattcttcttatggaagttattatccatctcctgtatttctgccttcaattgaattaaacttctggtgctgtgcatgcttggttgagagcagtgctaagaatggttatctcctagggtagttttgggagtttcacatctgaacccactaggaatagactaggcctggttgttgtatttattgcaatgcatacatgttaataagatttatatatgataatttggatattacctatttatcttacagtgaactttttgttctgccatatttgaacaggctcgtgaggctgctatggcagttcaaggaaagatggtagattctcagcgtaagaagagcaaaggttggtagactcctcgacttgtttgtgggcagtgctcttttttcaataaaattcggaacatttcgacagattctgtgtatgcacttgacatggtcgctggtgtggtaaacttgtgttattatcatttttatcgacaacaatatagtttctaagttcttggaattaaattactaaacaaaaagaccaacagtatttcgtacacctttaccaattatgttgtatcactataatttgtttagtgtatcagaaatccacttcggttatgttcatatcacgagggacttctcagtcttgatttacttgattctatttcaaattagggtcatttttttcatggcatgtctgctctattaaatataggagcaggctgggacatgattgaacttttatttttggtatgaattcggtatttctttggaaagccattggactctaggtgtgactttttactagttttatattgtgaaatcttttaggacactttttgtccattctctcattttttttaataaaattgctttgttgaggaaattttatactgtattactccttttctacttagtagattattaaaataattttaaatatgcaaaactacaatttttaattgattacgttaaagataaactttgtagttgagaaaaccttatagatataggtctaaatttttttggtcatttatgtgtcaccattttattctacatgttcttaatatgtaatttaacattgtattagatttttttagaggatgtaacttttatttttcattttttctgtttctgggcaaagatgacgtgtcttatttttattaatatatcagattattaacaattaactttgatctattcattctaaaattgcattttatcattacttaagcttaaatttgagaaagttgatttggagaggggtgattgagaattttttgatagtttccttttatttgtagttcctgccttctgaagcctatttccttttactggttctttggttaattttaataccatataaagaatattttggttcattatttcatgtacagaatatcatgatattatctatgtaagttctgattttaatatttggttttgatgtttagcaagtttgcggaagcttgaggaacaacctgaatggttgaagggtggaaagctccgtgattatcaacttgagggtctgaattttctcgttaacaggtatgcatgcttgtatatttgtcaaggtacgttttaattttttggtgttctaaatctgtgtattgcattttgcagttggagaaacgatacaaatgtcattttagccgatgaaatgggcctcgggaaaactgttcagtcagtatcgatgcttggttttctgcaggtgtagtatcaattctctatttgattacacttgcccttgcaatgtaataatacgtgcgtttttgttccttgcacagaatgcccagcaaatccatggtccttttcttgtagttgttccattgtccactttatcaaattgggccaaagaattcaggaagtggcttcctgatatgaatattatcatatatgttggtactcgtgcaagtcgagaggtgagacatttctgagtttgtcttttaagttatgatttatgaattttgtcaagtcttccatgcttcaaattgtctttctagcatttaatcaccttttccctatattgctatggatgtatacttctctttgatttgcttggttatttcttgctacatgaaaagaaatttaagctatactcagctgagtaagtggatgtggttttgatatttttctttgaatttaagttatgtttttaaaaagcctagacttaaatatgtttttagtccatcaaatttttgggtctatcttttttagtcccccaaattaaaatttgcatttagtccctcaaatatgcgaaatgttttttttagtccctcttgcgataaactgtcaaaaatcagtcaggaggggactagaaaaagcattttgcaaatttgagggactaaaaaagacagaccccaactttgattttgagggaccaaaaaatatatttaagcctaaattctgcaagctttttattttatttatttcttttacatatgattttttgtttttcattttgtggcaggtttgtcaacaatatgaattttataatgagaaaaaaactgggaagccaataaaattcaatgcactgttgactacatatgaagtagttttgaaggataaggctgttctctctaagatcaaatggaattatctgatggtggatgaggctcataggctaaaaaatagtgaggcacagttgtacacgacactttcagtatgtaacatttctcttaatttatttctgtgcaattgtttatgatagagtttaatattttatggcttgttttgtgctaatcttttaggaatttagcaccaagaacaagttgcttatcactggtactcctctacagaacagtgtggaagaactatggtatcattaacattttcctttcgtatttgaattgtcaaaaaaggaaacttacatcttttgtggatttgttggatttcttaatattgttgtatggataaatgttaataaatgctattactgaatataatgatattattaactgcttgatgtgtgacctagtaaatgatgagttatttgtatatcatttacatttacatttacattaaccatttaaagcagcgtacatcatggcatcctccagtcttaccccgcaagggtgcttctagtttgttgccttttcattaggggtgtaagtggcccacagattaggttgaattttgtgtgtttttcaactcaatccaattaagcttaattggattgggattaccttcttttttacaacccaatccaatccaactttaattggattggattggttatcaggttgggtcattaaaaaataaccacatctttaagtcttaaaaaaaaaaaaaagaaaatccttaaactaaaaaaaagtaagggataattttaaaaaactgtgttcataaaacattgtacaactcctgataaatagaaaaagataaaccttaaatatacattgttttacaaaagataagtcaaccaactgcattcctttgttcatttgctccatggcacgttcaattatggttttacaactatggtgatgacggcgagggttttagggagaaacgctattgcggcttgtgagactgagtgactttaagctttagagttttctaatttctatattagtaatttactactaagtttaatttataatatataattagtattttgttatgtttgttttagtatatgctggttgggttgggttgggttttgattgggtccaaaattttaaactatgaacccaatccaattacaattgggttcataaaaataaaatcaatccaattcaatgacccaatccaaccacaaaattctaaactggttgggtcagactaggcgggttcgcggattgggtccgttccgcttgcacccctacttttcattactgtataagtagcatgtatatttatgcaagctcacaaatgcagagtttagtagtttttgggaaactcccttgattgattgtttctcattatatgtccactaaattgatttctattatgtgtgttgtctgttattttgtttgctttggttttcttgtttgtttgacaattcccctcccctctccctccctgttttgtagggctttgcttcatttccttgatccggacaagttcaggagcaaggatgaatttgttcaaaactataagaatctgagttcttttaatgagaatgaggtataagttgtcatggataccctttactttttttctctgcttcttgattttccttgatctcgagattctcgacttctgcctcactgtaatttgatgtgcataaattattttgttagcttgcaaatctgcatatggaattgagacctcacatacttcgaagagttatcaaagatgtggagaaatcattaccccccaaaattgagcgtatccttagggttgaaatgtcgcctcttcagaaacagtaagtgcaattttagttctgaaagttttttcttttggaaaaatactattattgtaagttcactttctaaattcctgttgatgtattccttcgtgtaggtattataagtggattttggaacgtaattttcacaatttgaacaaaggagttcgtgggaatcaggttacatccctttcctgtgtttctaacaatcgtttgttgataacggatcatgtgctttcatcatgatgatggttaattaaataggaaatgccaatacgtggctttgatgggtggtttctttccaccatgcaaacttcattgattgtcaacagtagcaagctagagttagtgcagtttattatttttaagatttcttatttttattgggaaaataacattaaactccgttacactttacttcttttgcaaatagacaccctaaaatttaattttgtctcaattttgcaaatagacaccataaactttaaatttattatgattgattattaaactttaatctttttgtaaatagacaccttgaactttaattgcatttcaattgatctttaaaatttatccgttttacaaatattttttttcaagttatttatcttaaatgttaatcattcattgatttttttttttgttacaactcatttttcatatttaaaatataagaaataatattaattagatgatatatatatatatatatatatatataaaggggtaataataaaattaattttaaaatttccattttattttttgatcctaaattttattatgttttaatgtttggaaaagtttagaaatttcttttttgttggtaatttaattttaatttattttaacacaagattattaatgaaagggataatttttaagaattaattgagatgaaattgaaatttaggtatttatgtgcaaaagacgtaaactttaaggattgattgaaacgaaaatatagttcatggtgcctatttgcagaagagataaagtttaaggattaattgactgaattgagacaaaaagtttagggtgtctgtttgtaaaaggagaaaagtttaaggagcctttatgtttttttcccttttttaagtgaaaaaaaatacagtataaggtaaatttatgtgcatgtcaaggagctgaggtacatttttttattttttttttggtaatattcaattaaagggagaagatattatgaaaataaaaaatacccaaaatgaattaaaaaaaagggagaagatattaaaatgaaatgttgcatctgtttattatcatctggactgacaattcggagaagttttaattcataatgtatatttctatattcttttctcttgaaagatcatcactaatctttttctgctaaatttcaggtttctcttttaaatattgtggtggaattaaagaagtgctgcaaccatcccttcttatttgaaagtgctgaccatggctatggtggggactcaagaagtagtgacaacagtaaactagagagaattgtttttagcagtggcaagcttgtcatacttgataagctgcttgttagattgcatgaaaccaagcatcgtgttttgattttctctcaggtttgttgttgaaaattaaaactggtttactggattcttgatataattggaagcttttagctcaacgatgttccatcatactttttctttagtttagctcaactatgaagtgtactttttgttcagttgcaataaatataaaatgttcttttagttgttttaaagatgatctactggaatgtttgtgtgatcacatttttatgtgccattattcacttaaacttagtggtgtgggatgtatttcaatgacatatatcatattaaactatatatttcggctttttgttattgagcatgctcatttagctggtattgttatctactttaccaggggtaattgaaagaataagttgttcttacgcttctaattgaccgaatagaactagggaaggaaattagattgaattttttttatcagctgtcaatgacaataactctccagttattgacgtgtgaaccattccttaaaatatgttacagtacaagtgttctagtgaatcaattttggtgtctaattgttttaagtccccccacccccaatatgctgaacattgtgtatgtgcatgtgttaaagggtgatggtcgaggaatttttttatctcttacctgactgtttagctttttatgtgaacattgctcttcaagtcctaatgctcaacatttataaactgaaaccaaaaattcatttaattgattaggataaacctactgctgacgaaaatactgattgatctattacagatctaaaaaatagggaaatagtttgatcaacattgttcttcaagacctcaaatcctttgaataatctatgaactgaaaccataaattcatttaattgattaggataaacctaccgctgacaaaaatactgattgatctattactgattgctggtgaacaaatatgattgctggtctctctgaagtattaaatctttcactattgatttaggacttacttcttgtgcataattcatgaacaggtggatgtgaaaatcataaataacttctaacttttgatgttgcttgtctaagcatcctagtctgctttaatttttgaaacaaaagaaatgtgctttaaggattagtgtatgatgattctaacttaacagaggtgtattgcagatggttaggatgttagatatactgggtgagtatatgtcacttcgagggtttcaatttcagaggcttgatggcagtacaaaagctgagcttcgacaacaagctatggatcatttcaatgcacctggtagtgatgatttttgcttccttctgtcaacacgggcaggaggtctgggtatcaaccttgccacagcagacactgttataatatttgattctgattggaatcctcaaaatgacctgcaggtatttagctgatgtaattttattgttaatcaatgaaatggtgcttactgttacttttatgttctttaggcaatgagtagagctcatagaattggacaacaagaagttgttaacatatatagatttgttacaagcaaaagtgttgaggaagatattctggaacgtgctaagaagaaaatggtatgttaaaaatcattagatatccgccggctgtttttgtttcatctctttttctccaactttggcatcctatatttttatgtttaatgtatattttttcctaaaagacattcaattgcttattgccaatcctttaggtcaacaattttatgtcatttttcatgtgaatgtgttccataggttctggaccacttggtgattcaaaaactaaatgcagagggtagactggaaaagaaagaagccaaaaaagggggaagttattttgacaaagtaaggacatttgtgaaaactgtaatttcatgtgaatatttattaccttgctttcatcatttatggactgcattgaattgttttagtttatgcagacttggtttttttttatatatatatatatatatatatatttaataacacgattactgcaccaatcatttgtttctgaaatgacagaatgagctgtcggcaatcttacgatttggagcagaggagctttttaaggaagaaagaaatgatgaagaaagcaagaaacgactcttaagtatggatatagatgagattcttgagagagcagagaaagttgaagagaaggaagctgacggggaacaaggaaatgaattattgggtgcttttaaggcaagatatgcggacagtactgtgaattttgttgtttctgttttaaaattgatttttttgttaatatcatctttatttctctggtttgggaagagatagatttgtatatggtgaggaattgctaagttgtttctctttactttttacaggttgccaatttttgcaatgatgaagatgatggaagtttctggagccgttggataaagcctgatgctgtattcgaagcagaggtttgatcctgttcttttatagatatattattaaaaaattctcaaatgttgttgtgtttctaataattttgtgtaatgtttgtttcagttaatgcttaaaatgattttcttttatgtgcctcatctttattggttcttgtaggaagctcttgttcctcgatctgctagaaatattaaaagttatgcagaggttgatccatctgaaagaagtaataaaagaaaaaagaaggaacctgaaccaactgaacgagtttcaaaacgccggaaagcagagtattccactcctgcagtaccaatgattgagggagcatctgtccaagtgagaaattggtcatatgggaatttatctaaaagagacgcacttcgtttttctcgttcagtaagattctattacttctcacaattttcagtgttgtctcactataaacaaaatctattgcttttgttacttcctatattggagacagaagcatttcctaaattaatatattgttgatgatcttcatcccactattctgatgctattttctctcttccattctgaaaaagttagctaactagatgctgtaggatctgcatttaaactttagaacgtagaagtttgtattgtaaagattataaatctgagataggaccataaaattgtagttgagcagcatagaactgaatagttatttcttcatattttacttagccggttggataggctaaatttttggcttatgcatggattaatggagctatgagcttgaggtggcactgaatttctaaccgatccgattctagagtttgtttctttactaatatatttaatataaaactataatttatgtttccatatacattacttggaagcaattaatatttggtattctatcattgggttcatctaccaccgaccccaattaacttgggttaaaggtgctgttgatgttgatgttgatgttgattcttttcttcaagaattgtattaactcatatggacttttgtgcatgcatgatagtcttaggctaagcttgactatgaattaaagccagctcaaaatggagttcatggtgactggaaagtgtttgctttcttgaattttgctgtttttgttacagaaatgacatgctttttatggtcacatgtacttgttctttaatttctgtttaagttgggagtgatctactccttgtcagcatctaagatttcttccttgctccttttttaggatagagttaattgtggtacttccctgtgggtcatagcaagtgggtgttgacgttgtacttgttctttaatttctgtttaagtagggagtgatctattccttgtcagcatctaagatctcttccttgctcctttttaggatagagttaattgtggtactgccctgcgggtcatagcaagtgggtgtgttgacgttgcatttacacctcccttgagttaatgaataaccttttctttttattgttctttgggcttttcttttattgtgcgttatcattttgtgtttgctgtttgtgcatgtatgtcttgtaaatgcttcattttgttattttctttagcagtaaataatttttcctgttttatgttcatccccaattaatttgccaggttatgaaatatggcaatgagagccaagttgacttaattgttgccgaggttggtggtgctgttggggcagctccacctggagcacagattgaacttttcaatgctcttattgatggctgtacagaagcagcagaacttggaaatctagatgcaaaggttggtataacgataagttccctataatagatagggtttgaaatggttatttgtattcttatttttttagaagcttataacatgtaataatattgcatccaggggcctttgctggatttttttggtgtaccagtgaaggcaaatgatctacttacccgtgtccaacaacttcaacttttggcaaagcgcattggtcgatatgaagatcctattgcacaatttcgtgttctgtcatatctcaaaccatcgaactggtccaaaggttgtggatggaatcaaagtaggtgtatcctcttatataatttgtgttattattctgttgactttattgctgctttgctaattgtattttgcctgttttcagttgatgatgctagattgcttcttggaatacattaccatgggtttggtaattgggaaaagattagattagatgaaagacttggccttacaaaaaaaattgcacctgtagaacttcaacaccatgaaactttcttgccacgagctccaaatttgaaagaccgtgctaatgcccttttggagcaagtatgcaattaactaaattcttatttcagcattatttttttttttctttttcttctgtatttacaatttatgaatctgccaaggggtctttaatttctttttttgcttgttctttgctctttctttgtttctaatgcttttacatgcttcctattcttcttttagattttgttaattacccttcatgtcattgtttggtatttaatgtttcacatgtattatatctcaatcactagggtatttactagaaagaagagaataagaggtggagaagctacacatgatagtacggtggtcataatgtgaattgagggtaatatgcatgctattagtcagaatagagttggcaaaaagttgtgggagaagggaattttgttgagtgaatgtatttgagtgtttaatctcagactgatatcagattcagaatcaagaatattataatacttacgtaaataggagatttctggctgtgtattctatcatcttggctatatgatttacatgcacgcttgtttgttttcgtttcaattttgtaaattagtggactttagtttccacgctaatgattgtcctgcatagccctgaattttgtttgacttgcattcatagtatccacttctgtgacatgttccaagacgtatgttttaccaatttgttgatattttagtgtaccaaagggatgtgaatgctggcattttttcatcactcgttttgtgtattccgttgattaaagatgatttgaagcaataccccaatcttttcatgtgcatgttaacatcccccacccaccaatttatgatctactttcctactaagcttttttaattcttcctgtgtacctttatttgttgatagatgctacgctctttgttgaatctatcttcattgtttgtcacttaccatgatgtcttgattttcttgttgtataggaacttgcagttcttggtgtgaaaaatgccaacagcagagttggacggaagccttccaagaaagagagagaaaatatgattaatatctcactgttacgtgggcaggagaaaaagaaaaaatcgagttctgttaatgtccaaatgagaaaggatagatttcagaaaccccagaaggttgaatctatagtaaaggaagagggtgaaatgtctgacaatgaggaagtatatgagcagtttaaggaggtaaaatggatggaatggtgtcaagatgtgatggttgaagaaatgaaaactttgaaacgtcttcacaggttgcagcaaactagtgccaatcttccaaaggaaaaggtatgtcttttggcttatttccttgtagtacgtcctttttttatttattgtctcactgtttactgcctccctactttaggtgctttcaaaaatacgcaactatttacaacttcttgggagaaggatagatcaaattgtgctagaacatgaacaggaaccctataagcaagatagtaagttttcattcctcttggaaaggtttctgtgttgtttttgtatgatatccttttgtttttgctgttggtctcctattgcctctcaagaggataggttaagatagttgttggttaaatgtttttaggattctctaccacgtgttgattttttttttttttttgcttatttacaggaatgactgtgcgactgtggaaatatgtgtccactttttcccatctttcaggggagaggcttcatcaaatatattccaaacttagacaggagcaagatgaggcaggggttggcccctctcacgccaatgggtcagtatctgtttcatttagcagaaatggaaatccattccatcgccatatggagaggcaaagaggattaaaaaatatggctacctatcaaatgccagaaccagttgataatactgggaaatccgaggcatggaaacgaagaagaagaactgaaagtgacaatcatttccagggtcagccaccacctcaaaggaccataagtaatggagtccggattactgatcctaactcactcgggatcctaggtgctgggccatcagacaaacgctttgctagtgagaaaccttataggacacaacccggtgggtttccttcaagacaaggcttctcttcaggtataaagtaaccagcttggtggggattagagtggctgattacaagagtgttggctgttggctttcactctgcatttatacagcttcagcaattgtacattctgtggaatttttttcttccacccatgcgaataagaccttgcggatccctttttggtgtgttttggcggatatgagaaatatcccaacactgggattcacatccttgaagatggctgaagccgaaaagatctaatgcaagatgaaaaattagtcttgccaattgtttctttttcctttttgatttctactccttcgaagatgaccaagcaaagtgacatggcgaaaatcttgaaaagcgaagagttttacccacttgctatagacatacttaggaaactgtacattgtcaactctgcaattttattggattttaatgctcaccccataaagtattatgttagctgatgtagacaaaaatgtattggatttttgtggtaattatagctttaatttccgagatcttgtagctccttcaagtgagtttcattagcgaatagtgaatgcaaagtttttttttatactcagcatagtgaatgaaaaatgatctctcggcttcttgcttaagtttccttcattcgattaaagtttgatgcgattccagtaagtcatagaatgcatgtacccagattgagacattgttccagcatcttttaagatttttgaattattcctttcctttaaatttaaatatcaatctttgtcaaatccaaaggatttgcacagtgatgaaaggtctcattgtgttcacatgagtgagaatgatctatttaatagaataatcgtgttttatttttatcatatgcaaaatttccttggaccagcaacagtcatgtactgcgaacgagattagtatctgatccagtgggttgagggatacatgtgatctctgatctaagactaaaaaaaatattttctttgacaatcataactggtaatttagtttattcttggatcttgttttattcttttgttatgaccaattctcaagaaattaagagaaggattccaatgcttcatgcatggcttttgttctaccattaatgcattgtttaacatctcaaacgaattatatcggaatgacagaggtatagaggttgtataagtttgagactgtacagttaatgatgacttaagagaattaattgttattatctacaccaataagatgcatttactttttggtgacctatcacttgagtgaagtgtcatcgtgtacgaattgtcgagaagtcgacaataaagggcgttacacattgattattgcatgcagtaattaatgggacgtagattttgttcttaagtttatttgtatatgtagattaaatatacttgaaaacacaaacatgaaatgtaaagcttccaccaggagcttcatttcattccagggcaaaacatcaacgatgagggacatagtggaatacggatatataaacacaagaattaattcctgcaaatcatcaaccaaggaaaacaattcattcaatgggtcctttagtttttctttcaatttcctgaataactagttttttttaacaatatttaataactattttatatgattttaatattttaaatacaaaaataaccaaccattgatattcattgaaatcaaggatataaatagacttttttaattatatatatttagcattaagttaagggaagaacctactaaaacaatgataaaagtttaagtattgattgagataaaatgagagtcaaaggtatctattaaacatgtaaagtacttatatattatttttcctttttaattgatcatctaaaaaatacaattgaaaatagaaaaagcaaaaataggaggataaaaatcaacaagaattaaaacaacacatccaccaatccatttagttaattagctttcctatatgaaatgaaaaaaacacgaagttacaataagcagagacaattgacgagatcagagcaattatgtttggtaatggtggcattaagaaataggaacacaaataaacaagatgaaaccaacattgtaaaatcacttgattagtgaaacaaacaaccaaagaacaagaacactattccagactggtacaaccacgaaaacgaacaaacaaaccttataaaatcaactaattcaaaacaaaatcacactgaatcggaaactaaatacaatcgaaaactagtactccatcaggaagtgcacgaacatgaacagacaaaccttataaaatcaactaaatcaaaatgaaattacatggaatcgaaaactaaacgccaggctccgacgcgtcgtcgttgtcaagcttcggtgatgacgcaaggacactagtgaaacagtggtccatctccaaataagaagataaaaagggactcctcctatgagagctcctagggaggtgaacattgatatgtgcttaatgatgaagagttacatcaagaagtgcaccaagttggcctcaaggccaaggtgtcgttgataagctaacattgtggtgacaaaaagcagcatgaaaccgacgacaaagaaggcattggaagccatgttgtgctcaatgaggtaagtaacagtaagtcagtcgagttttcatgttgtatccatgcattttgacatttttttttttttttttttggaaaaactcagtttagtattagtttgtgcaacacgtgtccaagagttttcatgtgaaaaagagctcgaaaacatacaattttgatgcaattagagcattgacatgtgaaccacgatcgtggtaaactaaagatgattgcgctatcaaccacgactaaggtgagctaatcatagatcacaaatcatggtccaatttcttattctaaccatgaccatagtggactttgtacgaccaaggatcagcttcaaggttttattatatatattctaatgacatgtacacactttaacacaaaatcttaatgttcatgttgtctttccttcacttatatgttattcaactttttgatttttaatcaatgagagacttcaccccatacttgtatttcaacaatagtccatctcaacgtaaacaatgactgctcctatgagagcccataagtaagtgtaagctgatacatgctgaaggatgaaggatgaaaaactccatgaagaagcgagctaatttagtctcaaggtcgaccctctgttgatgaggtaacactgcggtgacaaaaatctaacatgaaaccaaagacagagaagaagtcacgcgatgcaacaaggttggtaatgtaaagtttcgcatagagaaaagaagcactatgacgttcaacagggtaggtaacactgtcttcggcgactgaaacattacttcatggaacaatggcactgccgagagcatcacacctcctatgagatagagcatagtgacattcatcaggagcatgtagacaacgactcctcttatgagataacaacaaagtggcattcatcggtgaaacaactatgcatcttacctttttatttagtttaatcttttaattccatccaatccaatttaaagccatttgaattttcaattttaatcttacttataactcttttttttatatatagaaaatactaaataaaatgtaagatatataataaataataaaaataatttaaaatatcaaatattttatttataagtaattatgtaactaataatataatacttatgcatcttaactcaaataattagtaaaaatatctttaatgaaatatattttcataaatagatataagttatatgatattataaatatataagaaataaaaatagaaatgagtatacacatgtatgagttcactttgaattggtttgaaaaatcaaattcaatccaataaaaaaatttggttttccaatttttgatcccttcattttttttatttatttattcggttctcaattttttggattgaatcggtttatgaacacccttaatattcacaactctaattatattgttattttcaagttttggttaataatgatgtttcaaaataaaataaaagtttaatgtctatgcactgataatgaaacaattttacactattatccaatcgcaaatcatcgtttgaattattttaagataatgattttaaaattcaacaaacttaccatatatgataagttgtgattgtatgactgagtaaaactttttacatttttttacattgttagtatataatatttttcctcataaaataaaatattattttcccttcaaaataagcctcaattggaacaaggtttgattaagctaaaaaatatcaaaataaatttgtgctcacaatttaaagctttaatcctacattgagtaagtttaggttaggtcgatcatgattcttgaactcaatatgggtagtggtttatagcaagttgggttaaaaatgtcattaatttgaaattttaaaatgacggccaagctcattaaaaatttggtttgtacctttttttgtcaaaacaagtttcgattaagctaagaaagtattgtaggtttcttcagcgagatccatgtgagattagacacacaacttattttaccacctcatgcgaaagttgaaagaaaagagaagaaaactgaatgaaaagtgaagagtggcagaatgtattaaaaggggatgaaacaacttttaagaacataaaactagaaaatctattttcaaatgtgagttaaaatgattttgaaagtcatttaaaagccttttcaaccccattttatccaaacaaaaagcttggaaacaacaaactaaaaactcataatcactttaaatcgagtcttaatttttccttcctatattaatatttcttatctatcaagtatcaaatgttaatgatatatatatatatttaattttattaattcttaaaaattttcatttccccttaatttaaataatttatattttcatttatggagcatttggaaatattttcttaattggttgccgacattgggctgcgttgggccacgttagatgcccagatgtgagtaagaccaacatcaagaaatcctcagccaccacataatacgaaacacgtgtccgtaggatgtaaaatattaaccccacgttacatttggctaccatggaacgatatccccataagatgcttcttcaacattttctattggccagctcagtaatgcaacacgtgtaccctctcttcaatcccctgcacctctccacacgggagcttcatgtgcacatgcactgcacacccgttcaagtcaacacgcatatttacgttaatttttccgacaccatcacaaaaaaatgcaacaagcggtactatttgtattattttttaactttgttcttttatttgtttatttataaataaatgccacaacttgtaatttttataggataaaattagtggattattttaggcagttttattttgatgatgtgtgtacaaccgcaaccttgttatattagaccaagttgtaaggtccccacttgttattttaaaccaattttcaatagtattaattattgaagtgaaaatttatattttaattgaaaaatattatatctaaaatatacttagattttatccttttctctttcaaattagccacatcgaattttacttttaactaaaacaacttctattcttcataaaatgttatatatatatatatatatatatatatatataaatattattaagaatttttttattactttgagtttgagaagttgactaatttctaatgtaagtaatgaaaaatcatacgcaaaaccaaaaccaaaagataaatgttaattaatgtttaaagaaatgaagataaaaatattaaaaatatatttcaaattaaagatacaaaaattatttgaaaaattaatgtgttttttactacactaattaacttttttcgttaaataggaaagattataactattaaaaaatgacatatatgttatttcaaatcatggattctattattaataatatttatcattgaataattaaaaatattaaataaaatacttcctattccatcctattataattattgtcttaggttattttacacaaatagaaaaaatataataagtaaataaaagagattaataattttataaaattaatcttatatcatcattaatttgttgatagattttattgttcatcattagttttaacttaaaatatgtttttaatccttaataaatatataaattttgtgtttgttttctgataaaattttctgtatattgaatctctaatagaataataattttatttttggttattgacactttttgttagtatatgataaattatcaatttttttgttccatataaatttctttatttgttattagtccctttaaaaagactaataaaaaataaaaaaattatcaaaaaataaacactaaaatttaataatttattataaattaaaaaagtgttaaggattaaaaataaattttttgttttatcacgaaccaaaaatcgaagattctttttaataaagaataaatataaaaatcaaatatttattagggatcatatatatatatatatatattttaattttaatattataagggatggaaatgaaaaaatgtaattaatattacattaaaaaattaaaataataattattttaaaattatttttgttttacaacaattataataagataaacagaatatattcaatatcccaattaggtaacgttgttaaaagaatttaattgaacatgtgagggcaaagataaatcaattaaaggttgcattaaaaactttgaaacatgaatgttcccccaaagaaaaaaaacgattggattaagacttcatgtttgattcaaactcattgtattcattaatgtccgcaataaatgcataaattctgagcatactaatactactataaaaaatggttaaaaataacaagtggggccctcacaggtggtatagaataataaggttgtggtggtgcacactatatcttttcctgctttccatgccacaatcatgaaacaagcaatgataatgatctgaggaaccgtgtttgtctcgtgtctcatccatgaagagaaggagaagaagagatccaaaatcagaagaaagttacgatttttcgagatgggtctgtccaaggagaatctgaaaggtctcatactagctttggtgtcaagtgggttcatcggggcaagttttatcattaaaaagcaaggccttagaagagctgcagcagtttctggtgtcagggctggtgagggaatttgtcttttttctttttctattagaatttctatttggaagcttgttttatggtatgcatgtctttgtaatttttttgtcgtcttgtaggtgttggtggatattattatctcttggagccactatggtgggcgggaatgatcacaagtaagctttaagtgctgtttaattttgtttctatgcttttagtattgttattttttcgttttttggggtagaatctggattttcttgtaccttaatggttttattttgtcttcataattggttttgattttatccaatcttgtatggaattaattggattttatttttaatagagtttttgaatctcataagttaggatgaattaatttcgttttgcattgtatagtggaacctggatttgatgtttcagatgctttattatttgctagatttctttattatacactcacatatggtagatcagttgtagtgaagttgaaggttgattaaaatatgcaaattttagtttatcggtcattttttatttatctgatttcttgcagaatctgtttctgtatggtttattgtacagtgattgtaggagaggttgcaaactttgttgcttatgcgtttgctccagcagtcctagttacccctcttggtgcattaagtattattgtgaggtattcccttaattttcattgttgattgagaattaaggtggtgctagcttctaacattggcgacataacatggttgcttcttcaatgatgtttgcatggtatcctctagtgctgttttggctgacattattctgaaagagaagctacacaatcttgggattttgggctgtataatgtgcattgctggtagtatcattattgttattcatgctcctaaggaacaacctattacatctgttctggaaatatggaatatggctactcaaccaggttagaatacactgtcttgttttttttttttttttgaatgcaattcattgtagttccttgattacaaatatatcctccctgcttgcagcttttctggcatatgtgggctcagtaatagtattggttttcattctggtcttccattttgcaccaagatgcgggcatacgaatgtgctagtttttactggcatttgttcattgatgggttccctctctgtaagtaaattaattaactgttatctctcctactaagtcttctgtttgataattgatttaaacttcaaagttttgtttactcaaagttattaagtttaaaacatatacaatctaagggacatgatttcatgtcgaatcctattttctaataatgaatttcatttcataaataaagtttcagcttccatataattttttatatatattttagttgtatggttatatgagactgctatggtctataaagttttctccctttcccaaattacatggataattatttatgtcataataaccaatgatatttactgaaaaatgtttgctttgtagtaacactgcaataatatggtggctgatctaaactgaattgctataattttgcaggtgatgagtgttaaagcccttggaacttctttgaaattaacttttgaagggaaaaatcagttaatctacccagagacatggttttttatgttagttgtggctatatgtgtcatcatgcaaatgaattatcttaataaggtttgttacatgatcttaaaattagcacactgggcttgtcgtacatatattcttatcaatgacctactagtggtaggtagttcaaacatttgaaaaattcttaagttgttttgttagtatataggatgcaaaatttctcttttatattttatgtgtttcatctattctatcttgatcatatattccataggaactttttttttttttttttttttgtgcgtggggggtgataaaagaaagatttattgtaaagaggaggaagaaatactagcgaggaggatatcattgggcctaagaggctcaaaaatgaaaaatgcaacaaaactgctaatgtctctatatatgaaggagactcccttacaaactatatgggtatggtagtggcaaggaagtgaaattacgcccatgaataaggatctgagtgattatggcgaaacaataaacaagcttcacaggaggcagtagtggggaagagtggaacatgtggatcagtgaatgtggttgaaggagagagagaaaataacagaaaattactggtggcaaggggatagagggaggagagtgagaaggattatatgatgggtgtgataaccgaatagggacaatgataaaattggtatcaatattggctaccctgagtgcagaagctagttcttcctcaggaaaggggttctctaatttctgctatttgtttattttatattgttcatcttgtaaggagctagtctccagctattaccctagctttctttttcattttcttggattgcagcactgtaacagaggtttatacctctgatatagttctaattgagtatcaacattagttttaccatccctattctggttcctaacaacattagtttattcttctaaaaaattgtacagtaaaattagttttgaatagagcttaatggcgttgattgattaattatcccaatacctaatgggataaggcttggctgctgttgtaggcatcaattccataggagtatttttgggcttagactcaagttttgagattttggaaaagtcaggaaaataagtttatttactttgacttttggcatatattataatattgctaaattaggaatcaagcaaagcaaagaagctcagatttgaggcttctgtttggttgtgacttatatatgagtttttttgtttatcattttgtagtgtttggtgttttgaggaaatagaggcggtcttgttgccagactattcctttgaattggaatgcagggaagtttagctacaacttcatatacaattaaggaagatgacaacttaatataaaacagaatgaaaaatcttacgaaatgaaattctgctaagctttttaaatgatctagaattcttttcatacctctttttaatatttcttttgtttaagttaatcttatcagacagtaagaggggaattacattccatgggaggactgttctgataagattatcagtaatggctccgatgattttactagttgcatattaaatcctccatacaacatacagtattacaacatgcgaattcctatggaatgtaaattcaagatagaacaaacctcagaactcagaacccagaactcaagatagagtacccgacactaaacctcagaactaagagattacataatacaacaaaagtcaaatcaagatgcaacaaaagtaaattgttttagatcatgcaactagtaaaggtttggtgtttggtactatatcattgcttactgataatctttaatcttatcagaaattgtcttccgatatcaattgattgtaagttctctatacaacatgattttacttttgtagtattatgtaatctcttctgagttctgaggtttagtgttgggtactctatcattcttatacaaaagagatctgcatattagtaagcatgtgcacgtgaacattagcctggctaggtggttacttttctgtttctttacttttgttggtttcttaatctgtttgaatgtgctatcccttgatgtaatgacttgatcttttagatgtttaaaatgaaagaattgtttaattgttgaaaatactggcattcatattgccaaactagtggtattgagaactcctcaaaatgacatagtgatccattatattttgtgaattttattattctttatcaagtcttgttcaaaatgatgtctgagttatattcaatggaaaaagaaatcaattctagagaattgagattttctctgtgcattgtatacaaagttcttatatatgaaattttggatcacttattcttcactgacatgattgtaatatttcaggctcttgacaccttcaacacagcaattgtatctcctatatactatgtcatgttcacaacacttacaatactagccagtgtaataatgtttaaggtatgatcaactagttttggcatttaatgctaaatgcataagatgtttctgttgtctacgaatggtacaagaacctatttacatttaaaaataatgcttgcaggattgggatggccaaagtggtggaactattgtgtcagaaatatgtggcttcattgttgtactctctggaacaataatgttgcatgcaactaaggactttgagagaagctcttcttttagaggtgtgataaatttgatcatagcacttaattctgccgccactgactatcccgatgaatgtatggaaccataattgatattctttcatatttgcatgtgttgaaacaattgcaggcagtgcttcttcatcggctatgctatctgcccgactttttaccggaaatggggactcattacttaagcaagatgatgaaaatggttctcccgagagtaatatgtgctcaagaaggcaagagttgtattagatggttaaagatcttaattcatttaattgtagtgggaaggagaacccttccctggagaatctgaatgagatgcccttcagattatactacatcatgcagctgtaggtaccaatgaaaccatagaatgatgggagatttgtgaagccattcttttatcttgagcatcttaggaatttgtcctcatagattttagttttgacattgcaagacggttctggaaccaatgctttgcagggtacataatgtacagcgtgttcacttgtcaaaagtagctaatatgctccaaatagttatgagattgagattagttgtatttctgaggctctctttacatgaaccagaaaagaagtgagtgggggatagagattaatagtttgtgaaaatcatatgcatggtgattttgctttgttttttcaattttatttatttgttttctttgtcaatttggcttggcatagaggattcatttgtagtttgtaagtaattagatatgtacaggaagctaagagacttctctcaaaattgctagtttgctatgaataagaaatatgttctcattcttacattaatacactctgtttgtgaagctctcaacattatttgtatgattatgcgttatgctcaagtaaacatatattatgaactaaccattgtgggggtggggccttgcaagtatcattgtatcaactactttgatgaagccaagaagtgaacctcacctcagaagtgtactcttaatgttagcaaggcaactcgcaatttccctagctgtctctttcgtccttgtctcaatttgtgttaataataatgttttgagaaaacacaaatataaagggaagaaatgcatgtaaaaaactgggatgggatcctaaattctagtgctcttatttttatgcaattttaattcccatacactgaattttgaaattgggtctctttgttggtttgacattcaaaatttaacatttgttgacattagtcataataagtaagctaagggataactggtaacaatgaaaaaacctaatttttacatctaataaaaaaaataacttgaaaataacaaataataaaaattactaaattataagaactaaaaaatgtatttaagttttatatcggttgcaaatatcatagaaacaattaaaatataaaatgcaacgaactacgaagaagtgtcaatttttagcaagaggattgctttctgcccccaccagacctatcttcgtttgcctgtcacaagatattacgaaatgacttaattcttaagttttcaaaacgcgacataattttgcattacacaagtttatgaccagatcacaagaaatacagtaagaaaaaaaaaagtatttattacaccatcagcgactaataaataataattgcagaaaagaaaatgtattgtatttatgggggtttagtacttaggaggcggtgtccgcggcaattaatctgaagagagggagcgagttggtgaagcaaattcaactcactggaaactcggttgaactcggtgtgtgtagaaatggcgaaacttgaagcgaagctagggatgattgtggactcggtgggccagttcttctccggcaaagaccaccttccttattgtgactcggacgtcgtcgctgtatgtttcatattcataagctctttctctgttagggttttcaatctcaaaatctctctattcaatctatttcttatcaattatgtatgtttttaagtgtttgagattgcaattgattaattaattgttcttgtgtgtggcactgcactggcagggatgtgaaagagaggtgttggaggcagaaaaacaatcatctgaagagtatatgcaagactgtctcctgcgtttatcatgggctcttgttcactccaaacacccacaagatgtgcaccgtgggatagccatgcttgaaggtctctctctctctctctctctctctctctcttttgctctttcatcatgcaattcaattatgtatgtatgtatgtatgtatgttaattgatagttaaatgacatgcaattacatggaaatggcagcatctttgcctgccacaaaggacccattgcagcaaagggagaagctttatcttctggctgttggatactatagaaattctgattattcaaggagtagggatctcgtcgacaggtgcctcgcggtatgtatccatctctctaaggaatctcaatcgtgatatttagtcacatttataatttcttatacatgtaacatgtccatgaagtatcaaccaatgagtttctcatcgatgactaagattgcttactttatcctttactcgggacttacttactttagaggagacaaatcctaattatacagcataatgattttgccttttctttttgtggaaaaaaagtatcgcaaccttgtgttttctgctattgatttcccctaatcagtgtggcagaggtgtatgttttggacctgaaggagaaggaggttgtgtttgtgttgtgtctctactctctagcataatgcccgaactatatttgctaataatctaatatactgtgagtatcaatgtgtagctagttgtcatctgtatcttgcattcaaaaacatgttttggaatagaatctgacttctgtatgcattctctgaagcctgtacttattttactgtaacaatgcgctgacagaaaggaatacaatacatcgtctgttgggacgtctcttaactgatgtctccacacgatttgaaattgagttaaccatcttgaacacttagacactggttgttgaatgtagacattggttcactagaatcatatactcacgtcttttttactcctcttttccttttcatatactcaagtctttgatgcgttgtttctttgttatagaggaaaaagttatagattcagtatctataaagttttgggtttttttttgtgatatccctctccaaacccaacaacaaattccaagcaagggcaaagcactgcattttttttatttttttatttttttttaaattttgatctattgcatatgcaccaatgcagcatctatgtactttaatgtgatatcatgtcaatgttttcttccttagattgcacccgactggaggcaggcagtgacactcaagacgacaatcgaggataagatcaccaaaggttcccatcaattcttgattttccactaacatttttctctgctccttttttttcttgccaagagcaagaggataagcactgactgcttcttttctttcattgtagatggtgtcattggcctaggcattgctgcaactgctgtaggacttatagcaggtgggattgcagcagctgtgtctagaaaaaagtaacagaatcctttctatcaaactcacatgatctggtatggaagaggcaaacatctataatactgtgattttgctgcatcttactgcttttatgaaaaggagggcgtgaacaataatgtgtacaaagcggtggagatgatgtctagatgagagatgatgtattgtgtgtcttcatgtttaaaaaaaaaaatacccctgtatttttgtcatttctgtaatttacttcctttaatgtttttatctctatcaataagcctcccccctcccccacatttcttataaagcaatccaattacgctactctctttgagatatgttatttaagccgtgctgcactgcgtctaaccttgaataaaaatgtatcaataatttcaagttcgatgcaatcattgttgaagattttacgcattcaacaagaaagactacgaacgaaattaaaacatatatgtgaggattgaaatatttatatagattagaacgaaatctttataccaactggattgaatcaaatttgggaggcatgtacaacaatttggcatctcgtactatgtgtgctttcacctggaaatctcctatggcaacattgacaacgaaaatgagagcagtgcaaaaacgactaatgttcattttttagttaagctaagctaatcaggacactcgtcttagaggtggagttaggaaagtcaacatttgtgactgcgcgtgcgctggtaaaattgaccataaattgttgcattggcagaattcgaattgggaagtgaagggtaatttatctttcactgctgatctccgtgagacttttctaattgttagggtatcatatccaatatttgtgttagatttacgtacgtcaattcaagattaacaagagtgtaaaacttatacaattcacgccaatttttaccacttgttgattgttatcatttgacatgatggcttgaaattgctcaaaccatagtcatccaagaaagaactaattcacggttgtttcaaggcacaatcaagaaaataatgcaattctgtttgaggcgaaatacccccctaggaccaaggtaggccatcacaaagaaggcacttttaggaaatcccttgaagcttcctaatcctatcccacaagaatcacttaatcaacaagagtagttaaatgaaggaaaattccgtgtaattccctctaagtacacggtcaagacaaaccacagaaaacaaattttgaggagttgcaattgcttgaggatttgaagagtgaggcttcagtagagagaccttccatcaaaggtgaagaacctgaagataatgcattactcaagtttatgctaattccactcttaatccgcagcattcttttttactcgaattaaaaatcatgtaacaatatttgaaccattagcatgtgaaaacaagatcacgtacatttttcctttcaaaacctcagtacaactgtacaagagtctcctgcagtgagtttccctatcataaatactaattatttgattctgaagtaataattttttaagtattaattgttgaattttcaaccggctagtttgaaagctatcttgcatacatcatctgacattgatgtttcctatgtaattttgtttggccatagcattcttggttttcaattcagcacttaatgacaaggtaattacttaacaagaactagtatcgacattagaccattaaaccacatgtcaaatttatataattggagattgacagattctattactaaggaatccaatagacacttgcttgtttttctcatttcttgaacaatttcttttaacttccttttcttccttgatagtgttctactctcagaaatcctcccaaataatatattttgcagcattctaatttactgatttatttttttggtgaattatgaaataatcagcatatatcatgatatactgattatttgatatgcagttaccaggcttcagaaaatgtcttattagacagaatacaattggaattgctaccattttttttggtcttttctttagtgctggaagtttaatgcataagatgcactaactcatcactacatcacctgttccacattcctcgtgcactagatctgatgtttaattttgacaaaaactagaaattcattcaactgaagggactaggattatgcagcgatacagagaaagaaaccaaaaaacgaggctcaatcaacggtgggattcacttgttctgttacacgacaaaagaaatagtaggttacacttggacagcaatttcttccttcaaaacaaattcaactgcgtcattttgccatgcaaggggagatggtggacagtcccatgacaatggagaagaaggaggggagctccactgcattgaatggtcaaaccaatctgaaaatttggacattggcaattcaactggttctgggtagcattgaggggaatcaggaacctaacgccacaagaaaaaggaaaacagaagatagagcaaatgttagacaaaggggaagcaacagtaaaaagtttctaatcaacaaaatgcttaaaaattgatatcagcttgtagtggattgattattaaatgcttcaatcaagattgaaatcatcttaaagcatgttattttcattgtatatgacaaaatgaaatagtacatattcagtggttgttctcaaagcacccctcagcttcaaatacatgtaaccaaaacaaactaaaaaaggggtcagaaaggtacatcattacctttatcagctctaggatagatatggaatctgcagagataaaatgttgttaggaattttatcaacattatctaataataataaccatcaacatgatagtcagggacatccaaatttaattccccgaaagattgaataggaatatgttcagatatattttaaatcaaatcatctcacaagaaatcctttttgtcaaaagttactaatgccaacttcaatgccaaatgtcaattctctcttcattgtattctaataaagattgctagaaataagttactcaagaactcactcacatgcacaatctcatcataatattcaataccacattttacttgtaagtcgtaactgtaaagttaaaaactacgacattgatttaattgatgtcaaaattataaggtaaccatcttgtggtaaactaagaaactgatttaattgcaccataaagattttcacaactcatgccatacatcgaatactgaagtaaaagccataccatcttgtggaagaactttctcaagattgaaatttctcacagtagcattttgagcctcaatgcacttcttgtgatcatgcaagaacatttcctcctttacattaatatcttccttgggtaaatttcttttcttaaccgaggcttcagggtggtgaagtgaacttttgtttgttatatcatttagagcttttcgacctgcaatccctgaactatctttctttccatttgtcttcgaattcttcgacttagtagtctctgtcccgagcaaacacaaagggcaaacaaaactaacacagtaagagaagagtgcagtaaccaccaatactgttacagaatgcaaagtcaatttctaaactttgaaaactttttcattgctaattcataatgaatcaactatagtagttggaaattggtgttataagcaacataacataaaaattaaaaatacttacttttagaatgaagattcaagttttcatctttgataatcaggtggccaggagcaacaaacttagccattatcctatttcacttttttcagagagcaaagactttgatactggactctgcaaaacaaattaaaaaattagtgtgaataaaaaaaaaaaaaaaaaaaaaggttatgaacatcacgaggaagaaaaacctttgctagtgctaatattttcttttccatagcaaaatcccataaggtttctaggaaagtgccgtttactcatatgtttcccaattccaagtatcaatcaatcaagtacactaactttaatgaacataaatcctaattcaaaaacattaaagaaatagaattcagaaatataacaaaaagcaaacagaagcaattgaacaaacccgaaatcgcagaaaggttaaaagtaaagaccgcgagtagagagcaccgaagatgaatgataacgagatgcagaaggaaaagaagaagaagaccgaaaacgttaccgttcgttggattttgaatttttcgtggaagcccgctacggtcatatcgtttatatatatttgaggaattttagacaacacagcccttcacgcaatttcaaaattaccaacttgccttcttcccatttaattcctaataaacattttaccccttcatatatatatatatatatatatatatatatatatattattgctaatattggctaggattttttcagccaacgtcaactaaacttatttttgggtcagagctatcttgtaaagtgatgaacctaatttaatttattaaaagaagaaaataaagtaatttaatttatataattaaataagtatatatatatataaaattaattaattttacattatttaatgttaatatctctaaaatatcctttatttaattgaggtattagttttagtgatttttctttattcttcatatcaagttccaataaaaattataaaaaaaatatttttattaaaattagtataattaaatataattaactaattttattcattcttacctcctctctatacttcaaatcatttgatcccttgaattaacagtttgatgataaataaaatgagttaaatgtgttttagtaaaagaaaaaaattaatgaatttgagtaagttttttcttctttttgccaacgtcgactaaagaataactctgatgagatgagaaaaagatatatttattccaactttaatgaaaaagtagtaatactccatattgtttttacattacaaagtgactgtgaattaaagagagcagaaaaggaaacaaggaccacatgcaatgatgcaatcatttagtattttaatgttacaagtccttgctcaatgacggaactaaaatactcaaattccccactacttgtaaattccaagccaaactctatccctccttctccgtctccactttcggcaagagacacacaaaatatttggggatgtaccatcatctccactttggtaggttttccaaatccaaagtcagtctcataaacatcaaatttaggtgaccctccaactagcattgtacttcccaatacaaacatcttcctacttaattccttccagttttctgcatctttaagaggttcagctttcatatcaattattgcccttgcaatgcccttcactgccttcacaaaaccagcttctccctttagctcctttctcttgagcaatgcatgacatcttgttaagcaatttccaacgtatgttgctggtataggatactcaaagcgatctctacaatctgctgcaaaacgaaagtactcctctttcatgatctcttgttcatcttcatcattattatcatcatgtctacattttgctttaacccagctagcccacatgaaaccacatgtaaccacgaactttgatagatattcgggtgctttcatcaattcatcatttttttccaactgattcagcacccatcttttcattccctcaatatcatctcttccaaaggaaactgttgccttaacatagtcctcatcatgattaggagtttgaccaatgagtttgagtttgtccttccaagttgacctctcttcaaagtagtctcttaagaagatggcctcaagtcccttggtgtccttcaacacttccctatcaaagcaagggggtgtcaagtcaactccaccacttctacaaatgcttgaccaatacttgatgaaataacagctactccttccatccaggatcacgtgagaatttgttatggcgatgcaaaggccatggttggggaaaaccgtgatttgcaaggccaccaatggggaaacatatgtgtcctcatcatcatcatcaccatgcacggttgtgaatgtcaacatgggaactaagtgatccaaatctttgagatttttggggtggttggatgagagatggttgaaatatgctttggactcgacgatggttaaggtgacagagtcatcatcggtgcagcgaatgaagggtttgtgaggttgtggtggacaccggagattcccagcgagagggaagaaatgttgaagggtaagagagaggttgtgtttgagagaagggaatagaaaatgtgtgggggatggggaaagtgatagaagaataggcgtttcacataaataggacgtgcataaggcaagtcaaggaatgatagaggaaatgacatggttctacctgtagctggagctacctgagatttatcaacaaccttatgttctctatgctctgccatttgttcacctgctccagacaatcttgatcaaatcggataaatttctctctcaatagattatctattgcaattgcatatatcaggatttcaaactccaaacctctaattaggctgaaaaaatctgcatttaaaaaagtttactttagagcatatataagggcgcatacaaattgttcattatacgatttccttccgaaacagtgatgaaacatgcatcgttgaccacagcccacagaacaaacaagagcagaaaatttaatccaatagcaatgccaaagcaagatgacggaacaaccatcaaacaaaacattaatcagaatagttcattccccaataatcccaaatttcaaacaacatataaatggatgcacaatataatgaggcctaacttccaacaaacataccttggattttcgagggaaaggaagaaggaatagaattttgagcaaggctgataaaagagacaaaaatcgtttgttttattcattcagaagataaaaaacgtttggtgaagaagcatattaaattgaagctccccactcagcttaatctaacgattaagaatgctcaaacgctgtcaaccgtcggataccatctaaacctaattaaatacagcttttagcaacatgcgctcacctagttatttaatttaagagaattgttagttattagttaagaaatttaaaaaagaaaatagaaatatttattataaaatttatagtacagcacaagaaaaaaattatgaataataacacaaatttatgtattttaattaaaaattatttttagttccttcaccaatatttgtcttaatttaatcatctaactaattgttttcacacacattaaaatattttctaaattttcataaaataaatttttaaatatttaatatttcccaaaaatgtaatttatcttagttatcttagcttagttaaaatataattgcatcaccattattaaagttattaatcaaaatatagtaaacaagaacaaaatatactaattccccccttcaaagtagtctttttattattaatattttcactataattttaattggtacactataataattttatctaaatttgtgaaatttttcactaaatctaaaataaataagagctcttacaaaaatttattttattaaaaatataatttcaaaacaaatgaaaatatatacatgcatgttcagttatggaaatgaacgtgttcagtacagtattccacaccatgaatcttccaaaagacaagtcgatcaaagacctaattaaactagcttaattggcgaatgtgttactgtctttaattttcaactcggccacttgtataaagttgcttttaagttttaacacattcatacccctaataagttatcaacttacattatttgtgtaactgatatttactttgtactactatttacataaaattgagatagctagatttatattgagtaaaaaaggctgaaaaaacctgttgaatgtgatgatgaataaaaataagtgctgatgaggattttttatttatttatcaaaatgagttattttacaaaattaatttttaaagtgagtgttttacaaaattatagacctgtcatgggttattttactatgaagactgaccattgatccatcactctctgcattttctttgtccaatttgtattcctgaagtgtgcttaaagataagaaattcaccaaagctcctacttcctcatgtctcaaatacaagaagaagaaaaatatgttttacttgatttcagatataattttttttaactttacttccttccatgttactgtttttataatacctttcatttcatcaagattttaatttcaatgactcatttttattttttatactaagttccaatcaagaataaaaaagtaaggtgaaaaaaaattaatttttaattgagattaatataattaaattaataaaatactttttttttcttatacacgagagcaaagaaatatttacatttttgtgtgttgaagcaaaagccattcggacaccaactgaacagcagcacacagcttttaggttgtcaggtattgctatagaccccaaaaatccaatcactgcaccctcccagttttaattaaattcattaaagacatatttttatctaaacgttcattgaattaacatcaatatatctttattcaccgttcattaaattatgctattttgttctttattttaatacattgaattatattctaaagatataaaaattatttgatataattacgtttttacacttttattcaaccacataaatagaaaaaatgttgtgatgaataaaaaaaaatgcgatttttctattttatgtactcctttgttgattcaaaattaaagaaatgtacgaagatacaagatcaatggacacttattaaaaaagacttaaatataattttagttaacgtaaaatcatagttttaaaaattgattcagtgattgactcggtcatggtactaggtcattggatcagttatcgaaccgatgaatcactaattgatccgcatgatctaacttataataaaaaaatataaaaattttatatctatcttaaatctttcttctggtacattcaaattcaaaagtcttaaaaacacaaatgaaatataaagaacacaagttaaaaaatgactattatctctgacatttaacatcaaagacatcaatgaaagtatatatcaatattcaactaaaatgaaacataaccataccacatcaatatagattataaaatataaagtaccaatccaaagttccaaactacatttttaaaaattaatttgggatcacaatttcacttgcaactcaaccacaattccagctacttctaaatcaatttaactcaacaaaaatgcaattgcaaccataaaaatattcaacaatgaatgaaaaatatcaatttaactcaaaatcacaaaaaaaactaaaataaaacaaaatgaaaaaaaataaaataagtaacctgatccgagccaacgggtcactggttcgaccacaaactcggtcgggttaatccgggttattccgggtcaaaagtgtaaccgatcgaacttatgactcgatccggtccaatcatcgagtcgcggttcaatcgattggagcgacctgatcggtctggattttaaaattatacttaaaatacatcagcataagtaacctaaatagaatagttaagtaacttattgttttatagattaattatcgatttttgttggtgaccaatctttgttgaaaaatttggttgatcatctttaatgaatttttctctttaaatcatattttttttcatccacaaaactcgaaactgaaattttacttaaaaaaattaagtctaatagcactcataccaacaatttattgatatttaaagaacttaaaatttaaaagtcaaaaaatatttttattgggagagaataaattttactatccatgatttttttttttcacttttttataattttcacattaaatatatttttttggttccaagtccttagcggttacaactttcaggtttaatttgtctttgtctatgcatctttccatatatatcgaagcacgacactgcctatatgcgaattcaggtaaccactaatagcatcgcatgctctcttctctacacaacccaactcgtcttctctcatgctcagctttttcttttcaaaaaacactatctgcacgcctatgtactctagtatcatcacactaacctctcactcaacaaattaaagtctaacccttgatttggagtcaaatagttaattccaattttcaactagataaaacatgtagccatgattattcatccaactccaattacaactagataaaacatctactctatcttcaacaatcctatctttagcactgctttaccatttaaaattgttcaaattttccaattactatacatttggtatcagtccatacgtatcacttactgagtgctataaagtgtttaaaattctagtgaaagtaaagtaataattagcttctgttggcatgatgtcatgttttttttttataacaaatattaatctattaattttgttaaaagtgtcaatttatgtgatatcatgttaccaaaccaataaaagaatttggtctaagccatgacagacattgataataattagtcattggtatcatcgaaaaagataaaatcaatgacacgtcattaataattaatcttccacatccttttttatcataatgatcaatcatattatatcagggaaagttataagggtagtgtgctcacttaagctgaaaagatagattacatcactcaaatccagtagttatatacaagagtttataaaatgagttatatatctattctagctgttgaagctagatacatgtagcagctagttatatatcctaagtccatgttcttaaagattagtaaaattatgtaataggaagaattaaaattatgtaagaagtcaagtgcaaggaccgtattcattggaaggataaaagtaaacgagaaaatcataggcatgagacaattttaagaaaacagaaaagcatatacaattctgtggtgaagataaataagttttttcttaaccctcacagaaaacatctgttgaatgattaaattggtatcctgaattgaaatagcaattaagtactggacaagttattcattatatgaataagcatcataaatatatcatgaaattaatcctacaacacttgttccagaaaaccctttattttatttttttcatttccacttaaaatcttcaacaaatagagtagtgcctaaagtatattctcctccttacagcacaccacaatgatccaaaaacccttgtggctgcttgttacaatatcaggcacccccatcacaaataaattcatatttttttaacatctcgttgcaaacatgaattttggacatgcatctattactttcacatctcgtcgcaaacttgaattttggacatgcatctaaaatttcaactgcaacattttatgtagatggctaagaaaagaaaatgttggatgtatatgtattgggatcaatatcaatgaccattaaagggtaacaaaggcagaaccaatttttggtatgttctgtcagcattccaaaactttatgaaacaacatgaattttcatattcatggtgccaacccttttgtggaggcttaatactacaacaattgtacctgtagggccaccaactaagaaccattcttacacacaacaccacttgcattcagaaaaaacatagacgaatccattcaaacatagaaatctcaactatttaattcaaaatcaccaagaaacatcgtttagtccataaacataaaaccaataggtatcgatatcgaacaagggcgtaacatgaggcattatatcctactatacaacataaagagccttgcgatgagagcatgcgtccaacgtgagagaagcaaagcataccgagaacgagtctgcataaagaatttcaatttctttaatttttgaaggaatttgaaatccgaagattttagtttattaaaatactaaaatcgcaaattcttcttaaaatctttatccaaacaccttattttacaaagaaacaatctttaaaaaattgaattaccctatcaaatccccccccatccaaacacacgaagtatttaaaaattaactaatgtttcatagcacttttttactttaacatatagtatgaaatttaaaatataaataactcctatatcaattaaaatgcaacggtgttaagattaattaataaagtggcgcaggccgcaagggtctctgctcgttagtcgttagatatgtctccaactcggtatgactaccaagtacaagtgcaagagcaggaaataaaaagaatacaaatatgcaattggcagggccatgtatatttaactacttagagccgtttttcccatggcggaaggaatttatatcccgtgtagaagaaaaatttgcaaatgcattcgcttatgaaatttacactgcagctcctttcaagcagagcttgcaacctactaagaatttacatttctcaccctcaacccccacacaaggtacatcatatagggaaaaaaatggaaagtgaaatcaaagtggaaaattaaagaagaaaacgaagaggaattacaaaatcacaatcaatccctattctctctcctactatgccaatccacctaagcttccctcgtcgtttttatattagatggaagccaaatgtaattgatcagttcgatcttgccctaatcccagccaaaatgtcgaaaaacatctcatttacaggttgtcatgtcaatgagccaggtcttcactcccaacaccaacagaagacttgtcaatcatgcgcacattgtactgttcgtagactcttccgcgattctcggcccaccattgctctgcttgcttctcactgaaccgcttccgactgcaatcaccaacattaaggttataaaattgttaatcgtgaaatagtgtgtagttatctgaattgtcccaccagatacaaaacattacggtgggaaattgctttctactttcaaaattcaaatagagaaaatatgcaactgtcttagacatgaaacataagaacatgcaaccaaattgccattagaatcaaaatgtgtcattgacgtaggaatatttttgtcaaggcattaacaccatgttatattctactttttcttctatggaagtatatcatattctacattaacaaatatcacagatgaagttctgacagagaaacaaagtctacagagcattgcatacctgaagcgaactctcttaagatctattatacctcccggaagggaggtgagtgtgatatatacaccaggttcatcttgttcaacccattcagtttcattacgggattcactgtccttagttctgctcccatttctatttgttgaatctgactggctctgtttagtgtgtcctgtgctacggctactgacagtgcttgatccatttgaatgtaactggtagtttgatccagttaaatcagcctctgggcttgaagcttgaatatttaaccgatcaatggaagcatagataacgtcattggaacaaggattggaaccaaaagaagaagcaagagtcggtgatttcacagttctagcagctcctacaggtaacctctcagccatgtccttcaactactcagcacaagtaacaaataaacgttggatcagttagcctagttaagatacatcgagtacaaatcaagaacataccttatataagcttaaaagatttaaaaaaaaaaaatccactatgttagcataaaattgatatcgggcttgactttaagtgtaacatttcatggctttactatttattttcagggtcaaatagtaattaagacaaccttgactatattgctatagctaagaaaaatttcttggacataacagttgatttgtttcaaaaagaaaaagaaaaggatccacccattacatgtaaagttttttgctcttttttgctttcttaatgattaagagttttggctataatagtctaatttgttaaagtagtttaagggattaaagtttctacctgggcagtaagtgactttattacttcctttgctgctttacatttggcagtttcttccccggcaattgctattgcatcttttagctgtttagcagttctttccaactcaacttcttgaagttgggccttccgagtcaggttttccacctacaaggggaaaaaactacttaggaaagaaacgaattgttaacaggataagctctttaaaattgattcattgaaccctccaaaacacaatggtaaagaaaaaagtgcagtgtcaaaataaaaatctactcactgttagtgttaatattttattatgagatagaattataaatcacaaaccctgactaccttcaacagtgacttgccacatgttctgcattgcaacaatatattaaaatttacatggaaatacctcatctctagcacacatatggtaactttatgatgacctggattttaaattgcaattcatctctagattattatcatacaatacagcaaataattgagcaactcactgacttgcaatgaatatgcatcttgctatctacatccaagcataatagtataaactagcataataagcatatgactcccttcttgccttcatttccacagtgtctatagctcatttcatcagacataattcacataaattaacgtcataaaaaatgaccagttgtaataaaaaatatggtaccatacgagtccattttgttaaatttctattcaaaccatttagggcaagaaagtgaatactgttgacgaatgcataaagtaagatacctgtgatcttaatttaataacctcctgactgaggctatcgttagtcctcttagcatcatccacaactatctttggggatgcaagacctccaagtgttggggttggtgtagttgaacgaggtggactaggccgtctagatattggggatgttgctcgggaaacaattctagatccaggaacagaagcagagaaaaatttcttcgatgatccaaaaacaggattaaaagatttagaaatattcaatgctccccattgtgaacccccatttggaacgggcgagacacggctgctgttgaattccaatttcttgtttttcttcgaagatctgctttccacttgtttgaaggattccattgaagaaaacctggcaagttgattacgagatctgaaatccaatttatcatccttatcaattaactccagaggcccctgattgacacttcctcttctgctcacagaatgagatgaagcatcagtttctacagttttcctaagtttattaagacaattatcacagacacgataaggtttgttggggtttggtgccattgaagccttgagagacttcttactgctacatgaatgacaaaaaacaagtccacaattataacaattgtggcgttttcttttgaaattaaatggcatacgacagcctgaacacatagactggtcaacaccagatacccacttatgcaaacaaatagctgcagtgaaagtagttccacaagcaatacttttgacatctttgtctctcagagcttctactaatgttggggtatttctatcgtctgtatcgccatgacctaaacggccatttgcacccttgccccaagtgtaaacttcagtccttgaagttaaaacagcaacatgatatgcaccacaagctatctcctccacaaaactctttgacaatttcccttcaacacggattggtagcttcccatcagcttgaggatttcctatctggccatagacaggactacccattgtatagacatggccagaggtagtaagtgcaacagtgagactatgtccacaagcaacttgacaaaaattgggttcaacaagggcaacacaggttggaacaagttttgcttccttatcaccatgcccaagtcgacctttgtctccatcaccccaagtaaacagcttccccgaagagcagttgctggaacttgaatttccaaccatgacttccacgactgcagcagtatgccaaacaccacatgcagcccgcacagtacgaagacccttgagagactctacttcccttggtaatgaaacactttttcggtccccatgacccaaagcaccaaatataccatcaccaaaagtaaataattgaccagcagatgttacaacagcagtgtgccatggtccacaagaaatataagacacgtgtatgccttccaaggggccgtttactctttttggtacccagtggctcacttgatttccatgtcctagaaggccataattgtatgtgccattaccccatgtataaagatcaccagaaagtgtaacagcacacgtatgatattccccacaagctacaagttcaatatttgtattacttagagcttctataagctttggatggagaacatcagagtcaacaccatgcccaagtctgccgcctgattcttccccccaggagaaaatttcaccttgtttggtcactagggccgcatgtcgtccaccacaagctatattctgtacatcaagaactactgcagattccaaagctttgggaaatagagcatccatttttacacccaaacaactcccaactcgatgattcccaccacccaaaacaccatcacctgtgccttccccccaaatgaaaacatcccctagagcatcaccatcatcatgaccagagccttggctagatgtgctaacagcactggatagactaactctaaaagcatccatacccattgtcttcatgtgaccatgcatactgtctgatcctccagatgacacagaatgtactgaagcactggcagaatctggagggaagaaacccttctgagggacagcatacaaaaccacatccaatgctttatccaaaccattcttaggggggctctcgtatggactatgaaggcaaaggtgatccccactgtcctgaataggacaaataaatattattttagtaaacatattcaactgcaatggagagaaaaagggagaaaatagaagggacataaagaataagtttataccttttgcaggctttcattactgccaaagggagaattcaagggagaacttcttctggtgtatgtccgaggactattagcctcagatggaataccatcacttcttgactctgttctccacttccggtgatggctacgagaaattaatgctttcaaaccactgaaccaaacttcagcttcatctttatccttgcatatctagtagaaaaagaatcagaccaccagattgtgttaaacttctgcatacaaatacattgatactgttcacaatatcaataacatctgtacaagcaaagcaacgggccaactgcagctaaaaattccaagaggagaggaatgaagaaaactcataccaagtccagtgacctatcattgtagataagagaaaatgactggtattctttctcaggtcgtggatatctttgaaagataggctgaaaaagtaggagccatgttttatcaatcataacagagaacctaatcacttgaaatgaattcactgtagatgctgaaagtcaagaaagcatgagtaatggctttttagataaatgtcaacttattagactaggacactgaaacagcacacaacatcatgtttctcaaagcaaaacataatctaatagttaccacaaacaagcatattgtaaactattcataatgctaaagaaacaaatccttttactgtagatggataatgaaataaatgatatttatatatcttgacttccagcacatggtggttacactcacatcaaaagtgcatacagagaaaggtgacacaaactgtattagtcatacaaacatcaaatttaacagaactgtcataactagttatctcaacatgataaggcactgttggctaaatctgaagaagcaaaacagtatcgtgactttgcactgtcaatctaaaacttactgtgcgttgcccagatataattctagagacatgactcagtttaaggtgcttctcttctttccctgagaaccatatcaaaacagattcatcctgaaaaagtagagaaggcaaatcttattttttggcaactggaaaacatctaaaaacaaacttcaaattatgaaaaaatataaataaaccagaagcaagattaggggaataataagataatcaaatgactttcaaaccatgaaatgacatgaaagtgattccataaatggcatgcataatcataaccaaatacaaaagtgtttgatatggtgtggtggtcaataatacggtaacatgcatacttaccttcaaatataccttcaagatatgtggattagaatgcttgctttaacaagatttggtaagtttttcaaaggcaagtttcccattttttaatattggcacaatggatgtcttaagcagatcaaacattctcatgcgggagggttgtatccaaccatacactagtaaattttccctgtaaactagtcagggctgcccacttacaatggtttactaaaagcaaaatcaagttttcacattttcaatttgttgctgaaaattcatgttaagctcaatgccataattatcgtgactttatcaaattttcaatatgttgttagtgcaaacacctttgaaaacctaatcttaaggcaatcctaattgatgttaagcaattgattaatctttctgtaatatttgtaatttttctagtagaccatgaagattttagatctcttaattttcagagtttaatttgtttaacaagtacttcacatttttgctcctctcttcctcactatgtcattcaacttcaaggtcccctaccctactatccattaaaagaaatattttcaccactatttaagaataaataaatacaaaataaaatgtagaaaaatcaagggtttgagctttgttttgaaactatacagggacaaagttattaatgccaaatacaagtatttaaaacacacacacacacacacacacccactttaacaaggattaatttgaatctacagataaagagtacaaaactcacattggaaagacggaaggggcaaaacttgggcgttccccttcttccatacttgagcaagcaggcccctttctttaaagcagtaatggcctgtcgataagatcaataaaagacttcagccagcatatataacacatctgaagataaaagaaaacttataacatattataggaatcaatgaataagcacagttcatggataacattcaactgacaagcaccaagggcagctactaaagtccaaaaattcaacaacatactgtctattagtcaatataatagtaacagcataatgcatttccttgtattcctgtggcaaaacctggtatctaatacccaaacaatcgataaaagagaacgataattaaatagaaagatctccaaatggtcaaattagtgaaacataaattcaagaaaaaattaatctaatattcacatagtcaatatataaaatgtttagtccactaaaaaagcatccaaatcttcgaacaacattcagaagtcacaacacatacttaactacgtataaacaaactcattaagtaaattttaattataagaaaatttcctaagcaacagctcaaaatcaccaagatttttcactgccaatcataaactagtttgacctgatgataatacaatcctagctggcagtcaaactaaacattgcaactagacttccatcaacatctccaaaattttaagctcccagcaaaattaagccaattacctattcccaatgccccgaacaacaacaaataagaacattaccaccactgtacagcgcacgcacaccaatcagatacacaaaatctaaaagcaaacagtactccagcatgaaattcgaagcacgacgctacagagaaaaagcttccaaagaaatggacaaaacaaagatagatagatagatagatatacacctgctcaatgtctctttccacgggaccggttctgctaagatccgaagccattctactagtccgcgacatcacgcaaaaaaaaaaaaaaaaacgaatagcactaattagaaactttcactctctcctcaaatctaaacactaatctttcacattcacccgttctcatacccgaacccttccattcatcaattcgcacactcaaaccctcgctccaacagctccgagccttttccggcgcacgaatccaccataattacacctccgtcgcgcagtcaccgaactagagagctgctccgctgcttcatgcggcgcgggaactgctccagcgtgctccgaagcagcgattggcaccggcacgaggtgctaggttgcggcgaaaggaagtgatcgaggttgcggtggcgatgctccgtggattccggtgatggaggggtcggcgagctcgcggcggcgcggcgaggaagtgccggaaaaacggaatgggagaatctaggaagtatgatctggaaaatcagttgcagaggggagagagagagagagagaaagcggagtggagttacaaaaaaagcataaaaaagaaacacagtgtcgtctctatggctgaggagtgagtgagtgtgtgagagagagctcaaaacagaagcaagctaaattctttttttttttttttttaattacgaaaagtgaaacggacacaggaatcgccctaattgtcgtcgaaatttacgagtttgcccctacgctacgcttttatttaattattattattggtttttacgttagtgttctgattaaactaaatgattttggttgattacaggcataaggaaaaaagtttaaaaagaaacggacatatttgagtaataaataaatatttttaaaaaaaggataaactggtcatggttgacttgagtcaatactatgagtattattatttattgctgataaaaacaaagcacaattatttaaaaagagaatttaaaaaatgaagaacaaaaaaaggtagctttagaattatacatgtgtatataattgcagtgccgaaaatgccggaatcgctttgtcctggttgggtggcggtgactaaagatgagattatttcatgattaatcctttttctatatatggagcagactgtaatattaaaatgattttaatttttatattttgtaagagatgccaataatatttttaaagttaaaaatatttaaattataaaagatgtataatttaagaagaaaataagaactaaaaaattaaagaaaatgatttttagaatataaattattgaatttggattaaaaaaattaccttaaaatatgaatatttacgtttgttttcctttaagttagaatcaattacctttgcacctcttcatttaaaaaaattatacttacctctcttgcattctcctaaatttattattctctgtcccaattataattgctataagaagaaaaaatctaatatatattatgtataaaaaaggttgaattctaagaaataatgtgacatgataatctcatatattttttaatattaaataatattatttaattcaaaatccatgctattactctacttaaatagattctattttatcattcattctatgatatattactattctattaaatacaaataattttatttttagaatttttattcttttattcttaatcaattattttattcatcttttagtattttttaataacaattctaatttttttaataatacgctaaaaaagttgaatgatcaatttattttattgcttcttagtattcttttagtttttttaggcaatacgctacagagcaactcatgtttttattatataattaaaaattataagaatgaaatataaaaagaaaatattaaatttataaatcatatttaaacattaattcataaaaaatgtacaaatgttaaacaacatttgaagttataataataatattcacccatttggaataaatttttagttcaaattatttttttgcttatttattcaattaaagaagatttttattattatattctaaattaacttatttgattaatgtacactttttcaattaacaatatatatatataatgaaagttttattttttgagtcatgttatgtgtcatttcatatttatttcctccaaataatttaattaatgtaaattttatatttattctattttcaatagaatcaattaaatcaattataatacataaaaatcatataaattggtatattcagattttatatttattatattttctaattttatataatagcttgaaaaaatcatgtaaatttatatgacatatttttatttgatcaaagtaaaaatgtagtgtatatatatatatatatatatatgattattggtatattttaaatatagtaattgttgctaaaagtaatttttatctgaacacaactaataaatagtcgtttatgatgtttttttttaatttgcaataggtaaaatttaaattaatttttactggtatattttactattatgaaacatacatttgtccaatcttaattgattgtccaataaaaaaaattaaatcaatattaatttattatatatttattgaatattatatattacaattaaaaagttttaaattcatcacaaatgtgtctataaaatatattaaatatttattttcatatatattaatataaatttactaaaatataaactaaataaatatattaaaaatttaaataatataaaaaattactcttataaattataaaatgtgaatttaatacatatacaacacatatggaactaaattatttgtagtaattgttatcttgatttttcaaagtaatattaattatttattttttacttatatcccttataatatttatgataaacaacaaaatctataaaaagaattaatgataatataagattaattttataaatttattattcttttcatatatctattatattttgttgtctgtgtaaaataagttagaatagttattattttgggaagaaggaaatattcttgtacatatcatgtgcataatctagacatgaaaatagagaaagtaccaatgttttttttttaaaaaataatagacgttaatgtataaaaaatataagtataatttttaattgtaaaatacatatacgttaatacgtgtaactaatgctagtttcgagaaatgtgtaaaaaattgctagtttcgagaaaagttgatatagttatttattaaaaagaaattttaaaataagcgtgttggtgaattaaatacttctgactaaaataagagaaattattattataactaaattattattactattcaattcaccggtgttcatctgccctttatcatcatctgaataacgtttttagtttttactatgaaatcctctgaagtctgaagcatgtacacattaacacttaatacatcatcatctatctgagatactgagatgcaactatcaattcgaaaacccacgtctcacttttggtgtgacagatgaaaattacttaaattaatgaaaaaaaatgtaaagatgttatattttttaatacttttcatccttatcgtgatggtgctctaaaaattctatagaaccaatcaatttgtccgcaccttgactaattcaattcattctttttttttgtaattgactaatttacttcttgatttggataaaaaggtccctctccatagattaaaaataaatgaccatcattttttactatattcttattattataaaattaacaaaatagtaaatgataaaaagtttaaatacgtactctcttaaatgtagttatttctagttaaaattcttacctgtatttacattcctacttttctttataatttagcaggcatataagacccttaatcagtgattcgaattattttattcccttctcaacgtccactgaacagtgaccactataaaaaaaatgtggcattttattacagttatttatccacggttgaagtaatatataatgactaacagcccgcgtgaatcccttttttttttaatctctcattgtctcactaattatgtttgggctctacaaactcatttgttaatttttcaaaatcacttaatttcgctcaaacttcatcctaatttatcatgaataatttacctagacttgggtctatattagtgacaattatcatatgaagacttcggtttgttaggacggtagtagcttccttaatcaacccattattgttacagtcttattttggacttctgccattacttaaattacctagacttgggtgtgttagtagtttcttcttcttcatgttttcctcttgtaactattccaccattgcaccattcatcacatatcaaccttgtaaggtagtctttactaattcacacacaagattccccatgtttcatgttgcatatactcaagttagggcacaagttaatgaggctcttgcctcttggttactagactctctccatttaattgttattagcaatacaatggttgtatagcttttccacaatcccttttcaaaattttattatgctttcatgttgtttgtcgtaactatgagaatcacttttgatttctttttgtcaacgcattgagatgtttcaatatgttattgtttttgcttatgtggattgagaaacaattcctaaggttgacctatactaagaatttctaaacttatatttttaactccctccaaaaaatattaccgctttaataaaataaataaattgtgtatgataaaataaatttatttcttttttactttattacattttattgtattttgaatttgttaaaaaaataaaaagattaagatcgatggtaaaaatatgaaagtttagaaacgtatagatgaaataagtgaagttaataaaacacataaaatattttaaaaaaatatcgtcacaattttagagaaagatctgtaaaacactctctaaccatggttgttttagagatcatagtcattaattggttccttggttttctagctagtcagaacctgaactacacttaaaatattgcttggcataactaggtatcaatcttaaacttagtacccccatcttatacttataaatatcaacagtactcttcatctaacattacaagaaatttatgatttaacattagtcaaatgtaactctaaattgcaaaagtcgacgcaaaacgcaaaatcacactgagcgtcaaattttgcatcgattcttcaacaaattaaacgttacaaagctcaaaacaaaatagttgtgtttgcatcattgttgacgcaacatgacattggtttaaaaatcaaagctacctttaaaacttccttcaaaagtggtcaacattatgtgtagtgaccacatggcaaactctaaagtaacactattaaagtatgcattcggtttgtcattagttgtgtcgacaattagtagttaatgctagtttcatcgatatatgactgacgctacatatgcataccacgcaaatcacccacctaactcaaacctttgtcccaacttaataaccctcattaaccatttatgaatttaggaataaaagccatgcaagtcgtggtcgatgaaaatgaaaataatcaacctcttgagcaattcttattttttgttgaaaatataaaaaacacaaatcactataaatattgttaaaataacatgagaaaaagctattttaatctttctagtagggttgttcgcggtctggatttgatcgattttgaagcaaaaaaccatccgatccaatccctttggtttggtaatttgatcatccattcggtttgaaatttttttcaaatccgatccaatccaatccaattttttttggtttggatttgatcggttttcgattttttaaaaagtctaaaaataaaacttatgagatttatttttatcaaaataaggagtatatagcataaacaaacatattcatttgacaaaaacaaacatcattttctaattttcattggacaaaataaagagcaatgaaaccttactgcaaacacccctagtgtgttttgtgttggggttttggtttttgggctatgatggggaattggcccaagtagataaagggtaatgtaagatttataatttgatcgatttggattggatcggttttcaccagccaaaccgaaaatcgatctaatccagtgaaaattttcagtttttttcggttttcagtttttcgattttcggttatcaatttttcagttcggtcactgcagtttgcatcggtttggatctgttgatgaacacccctactatctaggttgagtattacaatagagaaaacattgttttcaaaaggaaagtttggtctaatagggaaaacaaactttaacgaaaaatctctgatgactgtcattcctataaaatgattcatctatggagaatttgttcttgttctatttattttattacaacaaattgttacttcaatcaagcaaaatcatgtcaagacaataaaatttcatagtttagacactctcattctaattgtttgaatcttataagaaattcaacaaacctttcaaatatttcatttgtctttgaaataattagtgacccttaagcatgtgattaaaagtataatttctaagtttgtgtatataaaaaaaatatctctcaagagagattggctcctttaagagaatagtgtctcattatgactagatatcccatgtttaccaaaatagtttaaattttggataaaattataattttttttaaaatccatatcttaaaattagctttaggtttatttagagacgacactaacgttaatatgttaatacatcagatttaaccgaaccatctattaagctgtctccagcacactgcaggctgcagctatggcaataattaggcactgaaagcgcagtacgtgagcgggttcttatcataagcctcactcaccctgtttgtattattttttcaaattaattaactttgtgggttgctttcaccctagcttgtttcatgaggttgatgtgtgtgaagttattaaactccacacacaatcaagtaaagtgatgtaacaaaataaaaaagatctagcaaatggggacatgcaaaaacccatcaattccattgggtgagtgtgtgtaaaaaactaacttcaaattaatcaatccatgcatgtgcaccatggctggagttcacaaacacccatgataccctttgacaatggcacttgtctttccaacccttgttagtgattgagaccaacaccactgtccagtgtggtacacttttttggaaaagttggtccttagccacaagtcatagaaattcatggtcccctattcttttcctcaagtggtcctaattgccctacactttctaacttctcttagtcccacattcacagaatttacactgtagggtgatggaacagatgcaccctttaccacatgatatcaaaagcctttaatttgctctcgatcgaatccccccttggaattcataatagttacgttactttcatatcatgtgggaaaaggatacatgtatagaatttggaatgtttttaaaaaagtacgcatgatgagaaaattcaatgtatagtttacaaatttatctttgtttctcctgctgtgttgaattggctggagataaattaaattgacacaaattacatgagcgagcatgtaagttcacgcacaaaaaagattgtacttccaagagttccttttcaaatttatgtcctctgtaaaatttatatatccatgaatcactacctatgctaaatttgatatgcatctttattgattttggttcgaatattcacacgttaggtcccaaacagtagtatgttaatcataataatagctctggattgatccaacatatttattttaaggatcggttatgagaaattgataatgagctgaaacttgcgtatcaaaaataaaatttatctagaatattctagcatgtcagtgacactaaaattcttctgcgttttaaacgagtcttttatttgccaaaataataatagagatttgaatgtgagagtacaagtttattgtaaggactcaccccacacacattgtcacttgaatttgccaaaagaagagtaatactatcgtttgtagaggaatacatatgacttgttgaaggggtttgaatttattaacatataattgttatgaatgtaatggttaatgtaacataagctaattgtcatgttattagttaatttaaatcttaattatagaaatttgcagtgcatattttgcaaaaccggtacgtgtcattttaacctaatactaattaaacctagtttagatttgattcagatcggtttgcattgattcaattgtataattaatctaataattctattacctaactaatttaccaatttagttgttgaatcaaatagtacgacttgattttgacaacgctactcactacttatatccttatacataatacatttgctcatgaagaatattctgaatgctgaaccaggaaaggaaaaataaagataaagcaacactcttgagatttacaataataaaactcaatactcgatatttttgtaaaatgaagttaattaaattaagttcagataaaagcaaaagctgaagataattaaactataataaaatttattagcatataattatgtaagttaagctatattttcatgacatggtgctattaaccaaggaaggacattaatatctaattatttgaaatatggggtaatgtagagttagatgttcttcaaattgaagtaacgtttcagttcgcaattattttgtgaagtcgaccaaaccttttaaaagcttatttgtcaaattgacctatatgggagagagaacctatcattcacccaatgtttgcattagtgctcttcttttaagcatgactattgtgagaggttactctttcaatccattctgcgtggctaactgtggtccttgccctacaattattaaagagaaactatcttttggcgtaatttcatgttctcggctcagattcatggtatggtacgtgttatatacataattaatccccaattccctatggaggatctgcgccatatgatgtcaaaattcatattcaagttagattttcttagctgtgagtatgggaagttgacttgaatctactctagggcatatccatgatacctttcagtttttgaaactgtgatgttggatattaattttaccagaagttaatatttgtttgcaaatttaattagtttgatgattgtaagaaattatataaatgtacaaattgttgagtccttaactaatttgatagtaacacccaatagaaagagtatgaaacaccttttcataaaaaataatgtatgatatgatatttagccatttgcattcacacgtacacgtacgcacgataaattgtaaagttttaccaaaacgctaccctataaaaagaatccgacacatgattttagccttaggtaccctttaatttctttgattttcaaaacaatcctgtttttggatgcattaaaaaacatctaaacatctaatatgcaagaagggttgggcatacaatttatcaactgaatttaagagcaccacaagttaggtttagaaagtttaataccctacactaattaaacttttaatgagcgaaaaccgtagaaaacacatgtttatttgttaagattgatgaaagtcctcctcgtcacatgctttctttggtatccaattctgcgccgattgattaatttagttcatccttatcttatttttatgactaaaataaagaacagggtacgaactactacatacatcatttaattaacagtttcctagtcaggtatccattgtactaggatttggtggttgatggggaaaaaatccaaaaggtaagaaccaattcacacaaaacaacatacacatttgtacattttacataataaaatagcattcggcatccaattggcctctggattgtgctaatttaagatgcaaattgaggagagatttctagatgcaccacaccacccacagtcccacacccgcataccctaacaaaaggttggtaggtctttccgaattgtgatttttatattttttatgatagaccaaaaacacaaccaaattaacaaatgaagggtccaaattcaaaatcaatggcagaaggatgtcccaacttgagattgaatggttagatttctctgtatattagccaggaacagtttcctttgtttgtattcattattttcgaaacatatgtgagactttttttttttttaatcataggagaatgaggaaggaaggaggaaatcataaaaaaaaaataaaaaatggagacacaaggatctgatgagatataaacatgtttctaatccttccatatataaattagaaatagctatttccaaagagagtatttttggttactatttaacgaaaatatttttagcttttttctttaacaaaagcgtttctagaaaatatttttaacttataatctatttcaatctatcattttcaatatttttagttctaacttgatttcaatatttttgaaaagaaattatcaataattaaaactaacattatataataatataaatatttatcataaatctaaaagataattatatattctaaaatatttattaattaccaattttaattataatataatttatatatttacaaatatgtatttattataaattttagttatatcgaataaatatttatactgtgaaatgtacaagctaaagtactagttaaataaatactttataatatattgaataataaaataatacaagattattaaaaaattaaattaacatgaaaaattctattacacgtcctacaagataaaaataatataatgatatttaaatgataataataataaattcaaatgtagatcctatatatatacgtttatttagttaaataatatgagaataaaaaaatagttcaagttagttcttatgtaattttgagcagttttgcttgatttttgactgaatttttactatattaatactttgttgggacctctaacatggtaacacgtggaaactcaatatacctctaccatacgcaaatcttgccctaaaacaaagctcttcctaagttcctatatttatactttatactttgttgggacctctaacatggtgacacgtgtaatcctgaagtttctccattaagattcctaaccctgatatgttaggtgtcgttttccttcccaataaaatggactaagctctcccaagaaagggttgcttactttaggttcagtaacaagaaatcagtttttccattacaaataattcaattattgttaagcgagaatgataattgagtgtgtttaaatagcctctaaaatcatgatagattatggtgaggtggttcaacctttattttgaccaaatttttggatgtttggattattatcaaaatactaataaaatcaattatgattaaaaaaatcatgataaagttaaaagtaaataaaaataacttctacttctaccaaaatcaattttacaataatcaattctataaaaaaaattgtaaccaaagtattccccagccaaaagtcaaagattaatctttcgagatactgaaatccatttaagggattgacctctcccactagatattttttcatatatacaagggaatcaattttattcaaaatcaattttatcaccgtcaattcaaacacacttagtacggggaatatgcgccatgaaactaataagttaaaatcccaactaccaatcaatattatcctcactagatcgatatgagtgttgggtaaacaatacaaaactcatgaaacgaattgttaaatcataaagtagaagtagccaactctccaaagaaagagatcaaattggagcaaattaggatgccatacacactaccatattaaaccaataaaagacaaatgacaagtatataagctgtgcattatacctaccacggacagcttcaggaaatgagattttacatccaaaaaataacctgggtgtacttttttttttacagaggcaaataggtgagcacaaaaaacagcaaatggagagagtcactgccattgctgccagaaacaatggttcccacgttacagagaaaatgtatgtgtctttttaggctatacatacacaatggcttagagaaatcccacacacttgttagcatttatcaacagcacttaataatccagtgaggaactggtgtcagcagtttcatcctcgctaaagctagaaggcaagtctgcagcagatctgcatgatcatataaaatgccattagaaaagaggcctctatacatatcccaaaacaacttgattgaaaactttctaaggaaaaatagaatagaaaattgtaaattgggtaagaccatgatgtgtgggactaatccatgcaaggctataggcttttacattgaccaaaaggtggttctagtggggaatttaaatacttgcactgcaagtaaagtccacccacatggagctcaatttactcactcggccacacctagtgtttagaaatcctcttttactcaaagaaagctttttagccaaaatcttactagtgttttgattattatctttttttaactaaacacacatgacgactggtgataacactacatgtttgaatgtttgatctttaccgctaacaaaaaattataattgatttccaacaatcattactgtctactgccttcacaattattactgttagcatatgtgcaatagaagaacccttatccaattttcacgaggcaagcaacattcatccgaaaacaaaaattctaaacacaaaaataaatactactaaggttgtatttggccccagcttttttaggtttcttttcttcttaaaagtaaaagctctactaattagcttattctatataaactttgtcttttgggtttaggatcattaaaaaaactagtcatatatttaaaagcttttttataaaaaaaaatatgttggcctaacttctctttttaaagaaaagagaaacctaaaataaaaagttaagtcaaacgctacctaaataaacatgcacacaatctataaatttataaatctataaattttctattgaggacctgagtgatcggtcatgagagacaaaaacaaaacatgcatatatacccacctctgaattttcctttgttccatctcagcaacaggtgattttttcacattgtattgttgaagcatgtcaactttagctcgttttgcaacctatgcatatagtaaagcaaaacatcatatacatgcttggaaggaagggaatgagctcaaaaggaaatcaaataatcatattccaaaaggaaaatttagatatctaaaactaaccatgatttcatttgaaagcatccctgctccatctacattgcggtatgtattttttgctttcctgtcccccttaaacatctcttcctgcacatttgacacaaaatttaagcattttaaaccatctgtaagcaagacaaattgaccattacaaatataacacacagagggtgtaaatatattaatgaacctttgccatcctagcagataacccccgttcttcagtatccataggaacacgggaattacggattgaactagaaggtttagattttacatgttcactcctttgtatattctttggattgatattatcataaccatgcagcatcaagcctttctgcttaactgcaagcttctcttcatagtgatcactatggttagaagcagaatcagatcgcatcccctcaacaccatgtttagtgctcattctatgactcttggtgctattataagcagatgcttctccaggagagtcttcatacaaatctgggaaagagttccttccaggaaaatgactggtataaccatataaaggttgcctttgttttatattctggtgcgctttcttatcttgtttatcctgaaaatcagtttcatgcgaggaaccaaagtcagctccttccatatgcagatcttgggaactaaatttagtataatatgaatcatatctctgcaaatacacaagtaaaagagagtgagaaagcagggaaatttgtatcacataatcaatgttgttatgtttataaacaggataagtttaaaactgctcaaccgcaatgcaaagatttacatgaggattgagcaagcacaagtataaaattactgttaatacttataaagcaaagcacagcttctagtccatttaaaaatttaacttgcagtcagaataacttgaaacaatggaaaggttgcccctagcacttaattttttctttcctcttaagcatctgtaagaagtaaaagggtcacatttagctcaataaaaataaacattccattttagccacattttacttatcattcttggggaatcaccattctttgttttaggatagaaatctcattccaagaataagctcattcccactaagaaaggaatcttttgctattttgtcgagtcttgacaaagtttatcttaaactattttaacaaaatgaaaaactgtccacaaattgtgtgtgcattcaactcatatgttgcataatattatattgttaaaaaattaaaagtaaaatttattatttgcttttctaaatccaagattatttttgtcaataagctattctattcattccattttggtctaatcctaatacaacaaacaccaactctgtctggtgacttgtaatgggaataaccactccaatccatttctttctcattaccactgattcctaaaccataacaatgtaccatatttcaactatactacataatattctgaagccaatataaatggcaagatgatagcatccccttttcctaccactttgaagaaatccaaaacttaaaaatgagagagagagagattaaaaagaaaattctggtaaggggtgggtgacaggatctttggtttggtaacaagaggtgattgtagtgctatcaaaggtcagttaaaggtagggaatggtataaaagaatgtcatataaattttgagagttgcaagactgatgtcaaaagaagcgaacaacatggaaatcaatttcagctcggtttggaatcataaagttgattatcatactcatctcagtgagggacatttgtgtaactgcagttttggctttgtggagtgtgacagaaaatattgaaggactggatgtggtggtatttggtgaacatgggaaacaacagatataaatcaactttatcatatgttttttcctctgtttgtaattgcattacagaagcagcacattactgtggataatttcttgtaatggttcatccaattcgggtgcaacttgtgcttgatattggtcttggtaacaaaattatctatttgcctttcaaaaaaaaaaaaaattcgggagtcaacaagtcagagttgggttttgttctgaatcttctgatacatcttcagggctagttttaacttttaagtaaattcttttttctcatcataagcttgtaacataaataattaggtcactgtccaatctttgaagcatgtgtcatataatttaaacagacagtatttcagtgctaaactcatgaaaaatgaattagaaaggtcacttacagagctaagactgggttgtctttttgcagcagagatttctggagaattcggaagcagaggatttgtaacagagtatggttctgcatagcatccattagattataaaggtaagaatctcaattctcaatctactcttaaaatgactcaatgcagttagaaaaatggtctagagttaatgaaacgaaacagaaccctcacaacttagctaagatgaaatatttccagtaaggcacgcaaagagcaaaaatcaactatcttgaactaaacatgtaaaaatagcacattctgcacacattatgaaccataaaaggcagcatcagtctttaggaataagctttccaaatttaaggataacaaaaccgcaacttcttcaatgtatgtgcgttgggcatttaaaaatcaagcaaataaaaatgtaagacatcagcaaaagaaaagaagtaaaatgatctacacaaaggaacaaaaccttgtagttttgtgaagttcttggtatccaaagccttagatccttaaaacactagcttatgagaagtgacactcttttgacaagtgctcttaataatatagaccataaattaatcttataagattgtcattgaccctattagtatcaatactaagaaggcatcagcttaaattccgtaaaagcatctaaatcatcccaatgaatagcatataaacatgatgcaggttatttggaattggaaacacttatttactgttccataaacaattcatcccctatcacacccagttctatctttaaacattcactgcctatgacaaaaaaaaagaataatgcttcatacgcttttttttttcacaatttgatgtgtaacaacacattcctttaacccaatatggcattgtttcaatttcaacacttaacaacatttcagtattacaaaacaaattgaatgagacatttaaaaagtaggaaaatagaatatggtgcaacctaccattagctggatctgcagtttggcattcaaatgcccctggaggaagcagatcgaattctataccaagtagtggaccatcttccagataatgccttcctaactgcttcttaacagcagttatagcagcatgttctatatcgcccttcactttcaaatatcctgatggtttgtgtcccatattaactgcacctttgggatttaagggtggaagagctccattaggtgtaagatgtctagaaggctccatatcatatggatcctgaccttgagaaaacaacctttcttgcaaaaatgagctgctctcagatgatgtgtcacccagcccgctaacattttcaggataacggttcctacgtccatgactcatatctgcaactgacaattcgtgattgtagaggccatggctctcaacctccttaggatccagatacctgtgatcagcatgcttactgcttccgcatgaatcttgcccaagtccactgccatgatcttggatgacaccacttgaacgatcttgtcgcccattagcaacagcttcatctttcatcaatcttttatcttttaaccttctgtggcaaaaccatccagatatttgcttttctgtcaatcctaactcctcagcaagtactaatttcatttcctctgtggggtatttgtgctctggaaacaaaggtaaaaaaaaaggaaattgctaaaaaattacccccttggaaaaggcattaacacccatttacaaaaagtattcttaccattataaaaattctccaacgccttaagctgggccggtgttttcaactttcttttcttatttttctcattggagactttattttcttctgattgcaattcacttgattctaaacaccaacagaaatgcaggaagtttagtacacgtgttgtgttggaatggaaaaaataatgaccgtaatatatgcaagaagacaacaattaaaaaacatcttatctcatattaacctctcaaattgatccacaaatgttattgaatcaaaagatacaactatatgctgaggtgctgaacagttatgacaatatggaaaaggatgcatgcatgggcaattgaagtcaagttgctcatgtgaaatgttgataattataagaaccagaaagtttctttccttaaatttgaattaaaaagtgaattgtttagatcaaatatttacaagaaaatgattttgcaattaaaaaaacttgggagctgcttggatactatagagtatccttcactaacaatgtccaaaggttaggaggttgttccataggatcactgaagagttactaacacatagctaatgaattttgtggtcccaagttactaagtccctgatctctcagtaaatgcaatgcaacaatacaagctctatttatatccaattgataacactagatactcttaaagaaattgttattattaaatagcaaaaacatgcataaggtctacactatgagggtctatatatagaccatcaaaataaagataaacccctaaacataagataattataaacacaaactaactaattaccctaaatatgaaatcaaaattaaaatactaaataatatatatttagatcataatccaatctccatcataaggcggaagggagcggcaatcccaagagtgagtattgtgcagttaaaaaaatcagggaagtggacagccaaataaatcgaaatttagaaagtagctggagaaaaatctgttcattatctaagatatcaatacattctacttctatacactcgtgtcatctacccaccacgattttgccacgactcacaaccactagcataccatttttcatatgatacaagtttgatacaaccagcttattacatgaaactgatcagtacttgttccttatttctttgagttttctaatctcaactgaacaaagaataattttgaaagaatttataatttcatagagtcttccgcagagaaccacgatttgtgccaatcaccaccaagtatgaaagaacaagaagacgaggaacaataacaaccaatcctaattccacacattccacatggaaagtagatccaagcctcgacgcagtaaatggtcattgacagaacaaacaaaaacttctccaatccatagaaaaagaaaacgtggaagagaaaaatgcacgaaaacatcaaaaactaagtttcaattatgataaaaactaatcaaaccccattggtacccttcagtttgactcactttttcagaccccaaataccacaaattgaagaccttgaagccatacccaccattacaacaacctaacacaaaaaatccatattatgggttccaataatcaatctcaaagcatggaaattgaagtaatctgagaaaaatcaaccacaaaatcaaagacccaaatctctgataagaccaaagttgaagaggaaaacacaataccttccattggggtaaggaattgccgtgaacaacgcccctctgttaaagttttggggcgaaaggtgcaaaaaaaatcagtggcttgtgagaaaagcgaggacaggacccgtttacggcaatatgaaaagagaatgcaacaacattaacaaaaacgtgtttgatgcaattgaatgagttttcaatttgaccctctaactccgcttaggaacagagaaaggagcttctggtgaagttggaaagacaaagggagaagaaacaaattcaattcgtcttatgtccgtattttgcttgcttgttcgttccaatcaatctttgcattcctaaaaaattaattaataaataaatcagatttgcctccactaaacaaagtaaaatgcattttaaataatacatgttattttaatagcaattttaatcgcaattttaatcgtagaattaaataaaattgtaactaacaatcttaatcttaatcaaggtagtaatatgattgttattttattcttgatcttaatgttattttcgtcctcgtacgttctagatttttacttaaatatagagatattatgagtggacactgaaaagaaaatgattaaataaaaatggaaattatacttgttagtgtgtatttggaaaacggttatgtccaacataactcaagttatctctgattaatatatagttccttcttttattagggtttcaaaaggtacaaacagacattttgaagctacgtaacgataattcaaatacaccattagtcatgtcttcattgtgacaaagtgaaagtcgaaagaaaaaaaataaaaatgataaagaaagaaaaaaaagttattatctatagttaaaaagtgaaataagtaaattcaaatgcaatcactttttttcgaataattcaaatgccatcattgtacaaatgttcatatacctatcttatttaaaattcaattgatgctgagatagaatatgataaactagtttatcttattttactaacatatactttttagtatattcactatcttgtcttgttttcttagtatcatataataatataataaatctataatatatatatatatatatatatatatataagtattagttaattgttttaaatatatagatatttattattattattaaatttttaagaaaaattagtttatcatactctaattttcttatccattatttatcggcatactttatatcttatcacaggagataaattataatagaaaaaaaaagacactttttagaatgaagtattttgttttattttttttcttgacaccattgatattattattattgttgttatcatgtcattattattgtcaacattaacaacaccaatattattattattatcattgttattattattattgtatttttttattataaatattatcatcgcttgtcattattatcatcactacatcatcatcgttatttatcattatttaatttgtgttaaatatatgacaaaaaaacaaaataatattattcaatttgttgtttaaattgtatttgaccctgttttttaaaaaaattagtcttttctttagaaggagaagttgagccaaccacttttcatcaaaagttattataaaaaaaggagggctaaaaacacattttataaccgtctcctaaccccatcattttcctctctaacacattcattaaaacacatatataaacttttgcttgattaactttgattaggtttaacaagataggtgtacttaggacaattacaggagttaaattattttaataattaattgttattataatcaatataattataattaagttgctgaaaataattttaaaataataaatttgggatttatttatatgtataaaaaaatcgtttgaatgaagaaaaaattatataaaaataattaaaagagaaaaaaattattaaaaaaatcataagatataaattttcaattcatgaaaacaacttatctttttcattaaaaaaaatacttattaaattgtgtttaaaaatttaatttttttaatgatataataattttttttttgaactaactgtaatcacaaatcagattaatatttgacttaatgaattaaagaatattttaaaaaatccaaaatttttatagataaaatcaatcactaatttccaagcatggattgaataaaatcttatacataaatcaaataatagaagaatagaaaaaactttgattgagccacttaaattatatataaattctcaccataccctcttagacccaagaaaaaaaaacatataatttatttttcatagaaaaacaaaaaagtttccatgtcatgctagtaggagggttcattcccagtgttgttccttccgtgtctggtatttcccttggcatcaatggcgaagacattactgactcataacctacgcttacacatacacactctcagaccttcatctttccttcttcatcaatgtcaccgcaactccactcacgcgggtcccacagtccacgacctcgtccgtgcccggaacctcccagaagcccaatccctcctcctccgaatgatccgaaaacgcggcgtttcgcgcgcccaactcatcgattccctccttccttcttctcccactcccactcccactcacaccaacgccaccgttctcgatttgcttatcagaacctacgttcagtcccggaagcttcgagaaggctccgaagccttccgcttgttgaggcaaaagggcttctccgtttccatcaacgcctccaacgcgcttctcggcgcgttggtcaaagtggggtgggtcgacttggcatggacagtgtacgaggatgttgtcgcaagtggcacaacggtaaatgtctacactctcaacatcatggtcaatgctttgtgtaaagaggcgaggttcgacaaggttaaggttttcttgtcccaaatggaggggaaaggtgttttccctgatgttgtaacttataacactttaatcaacgcgcattctcgtcaggggaatgtggtagaggcttttgagctgttgaactcgatgtggggcctcgggttgaagcctggggtttatacttataatgctattgttaatgggttgtgtaagaagggggattatgtgagagcgaggggtgtttttgatgagatgttggggatggggttgagtcctgatgctgccacttttaatcccttgcttgtggaatgttgtaagaaggatgatgtttgtgaggctgagaaggtttttgatgaaatgttgcggtacggggttgttcctgatttgattagttttggatctgtgattggggtgttctccaggaacgggcgcttcaataaggcgttggagtattttgggaagatgaagggtgctgggttggttgctgatacggtgatttataccattcttattgacgggtattgcaggactagcaatgtggctgaggcgttgaacatgcgcaacgagatggttgaaaagggttgtgttatggatgtggttacgtataatactctgttgaatgggttgtgtagggggaagatgcttggtgatgccgatgagttgtttaaggagatggtggagaggggagtttttccagattactatacccttaccactctcattcatgggtattgcaaggatgggaacatgaatagggcgcttggtttgtttgagacaatgactcaaaggagccttaagccggatgttgtgacatataatacattgatggatggcttttgcaagattggtgaaatggagaaagctaaggagttgtggcgtgatatggtgagcagggggatattgcccaactacgtatcgtttagcattttgataaatgggttttgcagtttaggacttatgggtgaggcattcagggtgtgggatgaaatgatagaaaaaggtgttaagcccactttggttacttgcaacactgttataaagggccatttgcgggctggcaatgtgttaaaggcaaatgacttcttggaaaagatgattttggaaggagtttctcctgattgcattacgtataatactcttataaatggttttgtaaaggaagagaatttcgacagagcttttgtcttggttaataacatggaagaaaaagggctactgcccgatgtcatcacttataatgcaattctcggtggatattgtaggcaaggcagaatgcgggaggctgagatggtattatgcaagatgattgactgtggcatcaatcctgataaatcaacatacgcatcattgataaatgggcatgtatctctagacaacttgaaagaagcattccgtttccacgatgaaatgctgcaaaggggatttgtgccagacgacaaattctgatgcttttaccgctgcagctcttgttacaaatacctgatataaaaggttgaatattctttcttttggtgacatctaaatttgcctcattctgttgtaagcgttggttttgtattcttgtgataattttacttattcagatgtatatttgttatgtgttattaggtctagttgtagactatgcctatgccacactggttctggttctgtatatcacaggaagcacaaccctggttgatgtcttctgagcccaaacataaaagtcaagccttcctgccctggttagtaacaaagaaaaaaggagacactcctttctcgtttattataactgttcaattttgaatgccttggtgttgcttgtttcatgcttatagatgtaatacagaataatagttcttaggttatcagacatggtttatatatatattttttgtatttaattaaacaatgagattctatcttgcaactttcaatttgaacagaagaatcctgtatgttttagatgcttggaaatgcaacccgtccatgtttctaacttctaagcatggtttgcaggagctaggagggggactccaccatcgttcatgaacttcagactaatgtttttgttagtataatttattgaaggggaagcctggaagtcattgcaattatgaagcatagcatgggagttgaagcattctttttttcttgctctcaagtagcatgagagtagtcactggttaccacctaaggtctggttcaagttagttttaatacaacaatcacattccaattaaagtttatttaacagatacacagaaatgatgtggaattgactgtggttggttagactgatataatcatatccatctttggggtatactttttgacagttagaaattgaggcaacaaattgtagattttttttttttttttttgtgatttttgaagacgatccacatgaaattgttttcccaattttgaactctttccgtattgttaaagtgttggtatatccactggttaagagggatgtaatctattggcacattaattgcatctgcattgtgacttgaaggccaaagattcaaatcctagaaacagtctgttgacactttggaagttaggatccaattgcaaggtatgagacttgagtcccatattgaaagtatgacattttagtgtgggatttataactgcaactagtttttgtgttgtgattcttctaaggttctcatcaattgtatcagagccttacactatgtctccaagctgcaaacaagtggtgctggttgcgatgatggcatcagtgtttgaccggagctagtggagtgtggtggagtgtggtggaatgttggggtccaatttcaaggtgtggaacttgagtcctatgggattctaacgtaaggtttatagggctttggactctctccaactaaaacgactagcttttgtggtatggttttccgtcatattaaatatacatactcttcacacatttgatgtttcgggagattgtgatctgtttgaagtccacacttggtacgaggaacttcagcaacatacataagcaaatcagctagcactttccttaacacatttgcatgatgtacagatgccagcattagatggtatgttgtctgagattcttgacattggcataacaacagcatgctacttagttataatgagctaccacgggctgtcttggatagttggatttaattcctctgaaacaaaactgtgcactctttagaggataaaagtgcaattgtacccaatggttgagattacgataaaatacacgtactatgtgataaactatggaagttttttaaatttcagttgtcaatgttttaatcatttatgtctctgcttcttatcagtccctactacccttattaagaattgtctacatgctatatgtgtgcgtctctctctcttacatatatgaaggatcgtagagattgttcagccattgatcatgcaaagagttattaaatatagtagtgtgagtgtgtataacactgtaaaataacgtctttaatatgttataaaataagttttatctattttattgaattatatagtattatcttgatgattatgtatatttacattaagtgtcaaagtaggcaaaattatatctatcataacttttttcaaatattaaagtttcatcaatgtaactgttatgctaaaaggtatcatatggcaaattttgtctacaaaaaaattatgcaatttaaaatctaattcataatgtattgcatcgtgaaactattgaaatatactaatgtaagcagacacacacactcattactctgacaatcataataatgatgatgatttaattgcagttctatattattttgtaagatgcaataactcatataataatcataaaaagaaaataactcgtctataaatttaaggttaaccatcaaaattttggttgtagttatgcttttcttattcatgcaagaaaatgatttttttttaatgtttaaatttaagatcaaggcccttaacaagtcttgcttgacgaactagcggacccgtagaggtctaaaaagaattggatcaattcggctcaatgaaccacactggttaggatgagtttcattttacacactaatttttttcgccaataccccatttcgttactgaaaaaggtaatctagaatgtaaaaatacattcagaaatgtccttcctgtaatgaaagtgagtgttggtagaaaatttgtagagtgcatgatgaagttttagccctgaccaaattaaatttcggaaactattaggatttatttggcttgatattgattttttcttttaaaattcatacaaatttagattaaaaaaaaagatattaatttggcccagctcaatgaaattcggataaagtcagataattagtttttcattttagtttaacaagcagaattggctcaacccatttaaaagatttaagaaaacataataaaagtgaataaatgatgctatgttttggctttgctttctttgtctgccttccatttgagcagaccagattacaatttgaagggcaggaatgatgcaatgtaatgactaaatcttccttttaaagaatggatcaattcacctttcccttcaagtttaaacaaaataaaagatcatattccatttcagacaacaaactagtgcagacacccaactttctaatttctattattaactattaataatcatattaacaatggaatgatcaatgtcggattttcatcattatgcccgtttgaatggtgagattaatgcacgtacgaatcatgattcggaatgtatatggacatgtagtttgttgagtgggatgatatcatgataattgaagtattcaaaagccttcaaattagaagcaactacaataatgtatatcggccgaaaaaataaacaagcaacgagaaatggattatgaccagaacacatggggtggtatatatcatcctttcagcttaatttgcttactcttggatgatataaatatttaaatgtcaatgtatttttgtattgcttaaaacacatatacgtgacggtatacgtgtctgaaaaatgaaagtacctgaaaatgtttatctggtttaaaatttaaaataacgagtatattgtttatagtttataaattcaatgtaactcgatcttgaaaaaagaactaacatatgtgtcgtaacaactacagccaataaggattataattttgataagttgtaggggttcacatttaagaggctgaagctaatacaatattttgacaagatcatttttgtagatcctaaccctatgtggtcatctctattctctggtgatacataataatgaataagaatatgttgatcgattccatagtttgatcacatatataaattaaatattacaactacaagtataattatattataaactaaatgatgttgaacaatatattttctaaaaacaattatatatatcaacaattaattatattcacatattatactataccaacgagtctaattcaattgtttaaacagattatatgagttattataaactctctctctctctatccatctttaattcctgtgcataaaaaaatattaatttaaaataaaaaacatttactattaattatcaaaatagttataagttcatttgacatcaaacaatattaagataactaattaactcacaaaaataacaatattattacgataacttaaagcataatgctaaccaaacccaaaaatatatcaaataatcgaatgcttaaacacaagccaccccattgaactccatggtaaaatggtttatatgtgattaagacaatcatcccccattatccccatcaagaaggtaccaagaacgacccacaatttggccacagggattttagtctattaatataacgacatcatcatatcattgctttgtctaaagatgacatgctaaattgtttctaattgacttgtattagacatgagaaacattgaatggggacctaattaagaatgctcctgcaagttgctcaatcagacaaaatcaaatttgcccaagcaagtgaaaagtttaattatatatagtatcaacccacaagcaggcattttttctttctttcttcagaaatatgttattaggagaaagagaaactgcggctgcatgatgtttataacggctgagaggttgagactaatgatgaaattgacaacgatggtaatgatgttcatacgctgaaaattaagagtttttcaaattttcaatgaacaaaggggagaatttcaatatagtttcattgtcattaattgctgatgatggaggagaaccaatatacatagatatatactgtggaaacggataagtatgtgatcatattaagtatgcttataaattatattatctttaatttgttcgttaatttccctttctttgactgaacaattatctattcaggtgcatcatataaaaagttaaaaaccacctaataagaagttttgcaaaatagtatgcgatggcaagttttaccattcttagtaattaaaaataaataaatatacgtaccaacaattattgtggcttggataaggacttgtttaattttgaattatatggcatttagtatagagttgttaactaagaatgttgaaaaatggcaactgctgctacatttgacaacaaaaagctgacagcataagaagtaccttgttgttgatactaagggcatttccagtgttaggagtttatatggatttcttactgacttttggtgggtcctcttttaagatacggttgcttatataagatgcttaacttaaatttaagtactccaagaaagagaaaaagtaagaaaggatgccaggtcagataaggaattcctcctaagatactgcattagagatgacctaaagaatgcaagaacaatatcataaacatatatgtaatcactttaaccaaaaattaattatcaaaattcatcttgacgtattctaatcagaaagtaaactatatctctgacgtatatgttttagtatactaaaaagtcttattttacttaggtttatagataatttataaacaatcatctcttaatctaccgagctatatatatggaaaaaatcatgacagactatcaagtattaaagctaataatactttaaatgcaataatcctataataatgtaagtcaattttgaacttagaagtaaggtaaaaaatagtttataaatactttcccttttaatttatcgatatatttttaagaacaacactgttatttacgggttaataaatatcaaaataaacaatacttaagatgtagtgatcctaataaagagtggatttgtttaaacttaaaagaaacaactttaaaataaagaatttttaatataaatgtttttttaataaaaaaacagataaatttacttcttaaaataagtaaagaaaactatatttttaagcagaaataatttaaacaatcacactaaaaaataaaaaattacttattttattaaaataactgcacatttatttcaataaataaataagtttaaagaaactaaaacaatactaacacacttgaggttatagaatagtgtataatctaataacatgtttttttagtttttttagtttttttatttgagtaaatgctgatgaattatctctgccgactcctttcaaacggtaaattttaaatcccgcatttcaacttgatattcgatgcataaccaaaaacaaagtatattaaactaggaatgacaaagacgatagctgattagttaaaaataaatatatctctgatgactgatatagtaggcgcaaaattatttcaaattttagtttttggaaaggaaaaaaacacataacattaatttaaaaaaaaaaatctcgtttaaaattctccattctatcccaagtgttaattctttcaagcgcatcatcaatgaagacaaatatataactagatgcttattatattttgagccttgatttgttggtagctacattagctgagactgtggccactcatgtcagctcaactattttttgtttgcttttgtttggtaatttcttgtgttttgatgacaaatctgacgcctatcatcgtatttagatacttttatttgacgttatatcacagattaatttgagtcgattccaccgactgaaggaaaaaaattaactatttggaagagggcatcacaaatcaaccaccaaagttgaggaaattgcgcaaaggaaaattgtcaataattttttcaagacttcaaggctaaaatctatgccgttgatcatctttagagactttcttgggggtggtgtttttcttcaacctctttctttaatttttaaatggttaattaaatcgttatttttccatttctaaccgcaaatgctagaggtaccaagttgaattttattttgtctattattttctcaatcgtggtgattatgaataaaacgactattatattttgaagcaaaagaatatcagtaaattacactaaaactactatcattttctttcaaagcattttttttttatcgcaactagttgagaaaatcaagaaacaaaagaagctttaaatagtttagagacaagtcaatttcaagaattgtgctactaacctctacgctttattttatttaaaataaaatacaatatctatatagaagaaagtctcttgacagttgatatctgtactcttttcaaaactacttataaaatattattcctttatatcccaaggtttaagctagacagattgagtaatgcgcaagttttgtaattgttgacctaccaattgattgtgtcacaaattagcgggtgtattgacccgtaaatttgattaactagctatagctaataagtaataacatttctgtagggttgaagcaataaaaagttataaattcaaatcttctaactaacataatattctaattactaataattcgcctatcaaaacatatttctgtaagttgagttgaaaaatggaattagtttaattttattttagttaacctaattataattaaattggattttgtgttaggtcaatgatctaaatccgtttaacttgactcaacaaggtatacatattattacgtaatttaagtaattgttactgttgtttgagacatgtattatactatttggaacatctatttttctgtaaatagtgtttgatttggataattggatttgtatgttaatttagacatgtattggaacctttgataacatgatcaaattctaatcatgtttgaattgaagtagtctatccgtgtatcattctaaactttttacacaatgtatacattttcattttaagcaaggtttgattgtgcctgattattgttttgattgttaaacacctacaacctaacctacctcaaacccaagtcaattcatacctattttctaaataacttaggttaaggcattttgggaagaaaaaaactatttatttagttaaatagttaagcttaaagttattaaaaatatttttaaattaatttcacaaagaccgatttttttaaataaaaaaaatgatataataataaacaacattattgttattattattacatataatatttcaaagttatatacttagtttatttttaaaaaaaaaaacttaaactcatatagcctacatgtaagcagggggtcgtgtctagttatatacatagtttaatatataattatttataggattaattaaatttttagtccttcaaaaatttcatattataattttttgttcctcaaaatatttttgataacttttagtcattcattaatttttcatcatcatttttagttcctctaaaaaaatttgtccatttttaattcattatttatttttattgttcaaaagtagtctcaaatataaaataaacaaagaactaaaaattaacaaaaaatgattaattttgagcaataaaaataaataaaaaactaaaaatagacaaaaaaattagaaggactaaaattgctaataaaaattttgatggactaaaaacttaattatctcttatttataattagtgaatgcatatttttaataagagaaatgctaacactctctagttaatattgatttaaatttgttagaaattacaaaattatgaaggtcttacttattttttgttgatgcactcctacttatttaatgtatctcactcgtaattttatacttttcaattgaccactaaaaaaatgtgttacttgtactcttcttgtaataactggaatgctaattagtatttgtttgataatattaaaacacaaggaaaaaaagaaagagacatcaagtctcaaatcaatttttttcacaaaaaggaaagaaaagtaaatatccttctaaacatcttttattggtctcaaaatgaatttatatagaattctgctttttatagaatttattattgatcattctcgagattttcattacgaatgccaatgttttaaagtgtatcggtataggttgtttgtataaaaggattttattgaaagaaataaactaaatacggtattggtgtaaaaattaattaatattttatgtcgcacctttttaaatatttaacagatagttaatatttaactttccatataattgatgattacaagaataaattaaagcttacaaaatgctatttttagcgagtaaccgcatttatcatacagtcttataatattaaaattgaaaattcccgagttggagcactatatattttcccactcttattcatcaaattacaacttcaattccaaaacaaaaagaaaaagagaaagaaaagaaaaactataaattaacttggtagggagtcaaaggatacaatttgtcctaaaaaacggtgttggactttcctggaatattcaattatatataagaacaatgattaatgcccaaaaggataaatttatcatgtgtccaaatcagattataaaaatgaaaattcacatttctttatttctttgtagtgcaaaaggccaccactactagtcttcactcgtcatctgtcttaataaaataattaagtttccaactgccgcattgtttgtactttgtagtaacatgccctaattaatctaaaagaaagacgagtctagtattggagctttccaagtattctacaaaattggaagtcttatacaggagtacgtacacaaatacaaatttgtatatattgctcgatcttttatattttagaaacattttccataattacgtactatagtttttcttatgataattaattatagtcacagaaaatgtgtatatatatatatatatatcatattttttattttatcattttccgtcaatttacttagggaagatcaggtaggagagggaaagaagaaatcaagagtatggatccatttaaaagcataaaatcaacttagctttttgcttggcctgtttattttctatgattaatttgttatttttctctctcatgagcataaataatgaaattcattttagtttccttatcaacttgatactagtagcattcattttatctttatatcttcttaaatgtggaatttatagcttcttcctcccccattgtgataacatagtcaatgaagaaagaacatgaaatatgaacgtgcaagtacttttcttctttaaaactatatatttatgtacgtatataacgattgcttttcaggtgttctattgacaatgtaaaagtcagctctttagctccttgaggataggttacacagatgtatatcacatgcgaattttgaacaattctcgttattgtttcccattgtagttgtttattacttcaaattacacaattatttaaaaattatagtcgcattcatattatattctttccttttctttcagaaacaagtcatttattaatagctataaatttatttttgatgagttcacttattatccgaaaggtgacttacgaaaagggtcgacgttatttaataaaggctaaaacaatttatcaaagaaaatagaaaatgagagaaaattagtaaattgaacttctttaagtctttgagataaacttctttttaattcgtaagaatatctataaaaaatggaaatattattttccttcacaaatttttaaactaattacgttaataataggcttctattatatctatcgaaggcataaaaatggtaaacggattattacataataaaaaaaaagcagcaaattgacacgtgaaagtcacaagtttgatcttaaaccgacaacttgggttcgattaatatcagcctatgacgaagggaacttgcttgcgaaccaattaattttagtttgaaagaaccaaacgaacacctactgattttgaaatatatattagtcactccttaaattatgaatattaaatgaattagttgggtttattagatttaaaatcaacaaaattttaaagttcaaatcacggataagatagagtcaacaaattcaaacttagagatgccttcgcggatgattggttaggtcatattttcgatgacattgcacaaatgacagagtaatacggtggttaattttatccaaaaaaatgagatgactggatctaacttagtctttggataatgattaaatttctatatcaaaataagtatatgttatatgttacttgagttgagcacccaaaaagaaatgttacttgagtttcaagtagtgaagataaaccagagaatttagctaggtttgattttttttataattaaactgcttttctttgaagtagtattttaatcattctgttcattttataaaatgaaattttttatataattataactataatttaggataaataaattaaaaattctaatttataatattatttaagttctatgcatcgatactgtagaagtttttacagtcgtctcaaccatgaaaagataataaatatgacttaagtaattgttataaaagttaataaaattattataccacggtttttgattaaatgaaattataaaaactattcataatattagtatatgaattattttctctttataatattcaagcatatgtaaaatcttttgtaattcggtaatttgtgttataattttaatccaagatcaaaattatatatggttgatcaaaatttactaactctacaggattattttttttaacaaaattaaaacggcgtacacgtcttctgcctgagggaaattttttaatttccaacgccttttaacctttaagatatgaaatttattagtctttaattgtacaattgtactttcgccccccacgctggaccgtataaagtgccgactattcatacgcagttaataacaaagtaagaattttaacatcttttttttttatatttcttttagctctttataagaacaaaaatatctacattcatgaattaatcttcacccctaaaagagtaaaaccctaaatactcctcctattgtcctgtgcattatattaatgggaggagaaaaagggtaaccaactaggtttgaatataaatagtaaaaggcacacaaggtcaagggttaagcttgtgaagttcgtgtatgagttgtttttgctatagagcctggcacaagagtgtgtcctaaaagatcccacacacatcacgatatagaaagtgaaattttcaaagccgacatggctgaccagaccaccgaccccatcaaactttttaattaattgtaccaaaaacataatgaaataaaattaggaccacactattttatccaaagtcaacattataatatatccttatatatatctatatatataatctcttcatcatattcttgtctaagcagctagcttgcaccacttctctctctctattattctctcttattcaaatgggaaactcattgaagactccatgctttcaactcaacaccaattcatcatcatcatcaaaatccgtgaagctcatattttgggaaggaacatcaagatcccttaaagggaaacacatagctggtgagatcatgtttgagttccctgaaatgatggtgtgccatgcagactctttcttcattggacaaccaattcctgttctctccatagatgataaactcatgcctggccaaacctactttgttctccccattgatctctttgcatgcaacaacctcactgtggcttccatttctgcccttggatcttgccctaacaagtcgcctatcaagtttggtgcatgcccttttcagtacttgaagggttctgatggaagggttgctattaaggtcatgcctgagttcatcactaggctcataagtggtgaagatcacaacaaagagaataatggtgttggaacaacccctggtagcccctctagttttctgtgtagtactcctgagttgcaaaagcactatgaacagcttgtgaagtctaaggatcaggtgtggtctcctaagcttgaaaccatttcggaatacaagattaggttttcgccatgcagattcatagggttagagtggaaagaaaaagaaaagcccgtggaaatattttcttgattaattagaagtactccacacacacataacatcaatttgtacactgatatatacattaattatatttctttctggcctttcaggattaattagccactcgttttctttttcctggttatttataattttgtgaatgatattatggaaattaattgtttcaactttttctgagttgtttaatgcatttcttagttgatttacaaagtgaagcttgcatttataaacttgcaattgttccccaattctaagtcatgtttaattatatatatcttactgactttgtgactactaactatatattcatttgtatttatatcaattgcaagttgaagaaattttgctgcagtggtttaaaaagttagactcgtgatatttacacagctagaaataataaagatcacagacctttctttacacactcatctatttcttcatttctcttgatctctccctctcaattataaggtcattttctctaagttttgtgattcatatatttggcttccgtgtgtaaataactacagaaaaaaatttgctgatcattgataaggagtgagatagagacaaaaaattaattacaaattctattgaaggatagtatatatagatgtggacactttgacatgaaacagctgattaacactcattgtttctgtttatttctctcttttttatcacataatattacttattatgcatatactttcctctttcttttctctttctcaccaagtgtcaaattaaatagacgagaagtgttcatgaatcattttagaattctattagacagtcagttagagtttctaaacataaatattgatgaaaacatagatagagagctacaccaaggtgtcttgagacgaggaactttgaagagtaacttggtgtaaaagacatcatcagttttgcaaagaattgaacccttgaggaaatttaacttctgatcaggaagccctcatatatatatatatacacacacacagtagactctcaaaaattgagcatctggaaagcatatatatagtgtgtcaagagccttgggaaagcctaggactttctcctagcccaagacgtacctaggtttccccttgtcatatataaaacctatgttatgttagaaattaataaatgaaatagatggaaattaaatagatcacagtagttgttattatatatatatatatatatatatatatatatatatattatatttattatatacaaatacattttcataacatttttttctgcgcattttcctttatcaccttacacttctctctttttctttttatcgatcttttttctttattgcaagaatgtgaaataggagtgacaacattcttttaaataggataacatataaataaactaataaaaaaggatatttttccatccattcaatgtataacaggatagtttataaactaataaatttttatttcattccgtctttggtaattttattgcattctacttttatcccgtaatattatgtagctacatattttagatatccaaacgttaacctataaatagatcaaaagataatgcgtcgagtactggtaactaaccttgcgtggaagcaaaaagggtaggaagttatatatgcattgaacaagggagggagatataaagttgattcattaattgggaaaatatgaaggaagaagaaagaaagaggaaagaaatgagagattgtgggtttgaattcttcaactgatatttttgataaaattaataaattaatatttatcaataaaaaaaattaatcaatcagcaaagacacagcgaaggagaaaatcctctttgtcaaattaattagagcatatttagtgatagatcttaaattgagatcttagactattttttggtagattccataatgccaaataggattaaagatctcttaagatctcttccattttttctttaatggtagatctcattttgagatcttaaagagagagaaaaatgaagaaaatttattcttttttgaacattgtgcagatcttaagagatcttccacaagaacccatcctacatggtggagatctcttcaactcctttattgggagatctaatgaagatcagatcttaaactcaagatctttacttaagatcttgcactaaagatgctcttagaggcttaatgcagtacgtgtctacctcagtatagcgggtccaaactccaaagaaaggaaaggctgaaaggaaattatatgcattatattaaccagaagatttttgttttaatgccatttaatttagccattgttacactcttaaataagcttgacccagcatgtactgaaccaaataactcagtgcatcctagtgtggtccttcgagtcttccaagactttaccccatataatgaacattattttcaacaataattatccttaatactgaacatgtaccttggaattaactaaatttagatctagggtatggctatcaaacagggtgaaggaattctcttttgttgtttatttatgagtggtcaatgtatcccatgaaatgtttgaaggggttgtaatatcatagtggatgtatgatgtggcttatataatgaatagaacacttgtctatgttgtttgaagggctgcaagtgctttgggtagaaccttattattggcagggtctctgttgtgtattctgtatatggattgattgctccttgtattttacttttttatcttagttattgatttttattataaatttaatgattaggattaattatttataattatcattggattttaagaaaataaacaataaaaatgaggaataattctaaaaaagatactctttgacaattaagttgatccgtcttcggtataattgatatgtagtcatttgaggttgagaatttagatagtaaaaataaaattaaaagaaagaaaaaaaatgaatgatgcaatgttagaatttggtaagcatgtgaaataaaataaaagttttgcgtatgtcattattcaaatataaaacatatatagccaatgctcatacacaaagataatatgagttgcattatcaattcgtgagcatcttaaagtaaaggaaaaaaaaaaaaactggaccatgatatatataataccgtgctatattttgacttttgataatttacaaaatattgtactttttatatataaaaaaatcgattatttattcctcataacaaaagaattgtagattgaaatttctaatagttctcttgtgagtagattattcaatcaatagtcaaatctgtactatatatcctagtaactaattgtataattcgtacatgtttattgtgtataaagtatatggttttgtatataaactttgaaatattcttaagaaattgagaagagggataaaatgaacaaaaaaaattattagtcggaaaggtcaatgctctttgtataaaagaaaactcaatgctcatcgatgcattatttgaaattcttttcttttttaacaacatctgttgtgtcaatttgggctataataagtggttgaatggcccaatatgtaacatgttaatcgaagtaatccaatttagtcaaagcccagtgcagtgtatttgcccccaaaaaagtagtgcaacaacgaaaatgtctgcaacatttttgggggaatataaagatatgagttcgagcaaccgttaatgaaaaaaatataaatattttttctacaaccaaaatgagacaacttgttttttttatctcttttagttttagagaaataagttttaaatgctcatatgatatgaagtaacaaagataaaaaaataaaaaatcagtttaggattattttagctccaaaaactactttataagtgaatgttcttttttctcatgttgatggctgaatattatgaacataaaacttacaagttgaacatcagtgagtctaagtgatccgatatatttaacaacaaataaacctaacaacatttttaaaatatattctaatatcatatttaattgtagatttgaatctaattcaactgcaaaaataatgcagaataaaataaaggtttttcatttattataaatattatttttattcatatcactagttaatatagaatcttcaataatatttttacaatgtatttttttcaaaccttccaacttaataaatagaaaaatatttgaatgtgtttatgcccatcaagacaaattgaatgtgtgtgtgtgtgtgtgtttttacattaagtgtttattttgtgaaatattaagaaagtttgaaaattgagtatacagtaagaagatatataggtggggatgggtagtgttatattatacactttatagatggtgtcaagtgaattatctgattatctgatatttaaagaataaaattagtataaaaaaaatggtgatgtgaatggctgggaaaagatgaggggtagggttctgaagatttgagcaatgacagtgagattacataaaagagagagtaggtgtgtgtaggggtctgtactgagtctactgaaccaagcaaacaagcccagactttttctctgctattgatatttatgtgagggaccactctacaaactactacactttatagaccatcgtaggtgatttaatgcattgtgcttgtgcacgcattaaccccccttcttcatttcaatgtagcatcatctacatgcaaatttgcaagttctttattgttcgggtacaaatccacgttcctttgtattcttgttggcgaattgatttcgataagttttagaggaaaaggacaatttcttttccatgttattatttgtgcattatctatattttaatcttattggattcttatgtgggggagtgttaaaattatttgtgcattcattaaatgaatcaaagattttagaacaattgattcagcaatcagcacaatatgacatcaattttaggcatgaatagtgtggtaagatgtttcatattagttaggaatacattaatgatagaggatcattgttaaatggctttgtttatctcaattttatagattttataatgtgatatagatttaagcattcttcacaaaaattcaatcaaatatttaacttaattttgtagatcttataatttgtttatctccttttactatcttattttttactttgattaaattaagcttattttaataacttatttttcataagtcacctcaagtattttattttgataagttacttgaagaagattatgaaaaataaactagcttaaaaaaatagcttctttttgttctcaactttatttttactattttatttgaaattttattttatcttttttttttactgtttgaaaatttctcttacctaaattatcattattacatgcacacaacaattaatttgtcaattattattatcacaccgttctttattgttataaattatttgaactatataaattttatgctgattctttttaaaattatataacccaatttaaacaaaatttcaaatatatatggttagtttaaaatagaatatctgatttgtatcatgtttcatggttatgtaagtgagagacgtacatattcaaattattcttgtataaataaaaataaataaatgtttaagaaaattataaaaaaaacactttttattttttgttttaaaataatatcattaataaagtatttaaatgtaaaaaaataattttaaataattcatatgactcatacggattgacaatctgtaaacgtttaacacaaacaaaaataggcgagaagagaagaagctgaatgatatatgttcgtatttaacaaatattatttttgaaaattaactatataatgttgggtgtatgaaaaatatgccttggtgtaggaaacaaaccccataatccaaaggggttcactggctatgattgtctagagacaattgatggagtaacatacaaaactttccagcaagtatctcatgcaataggtctattagaaaattatcatagatgcaattgttgaagcaagtaaactttccttccgaacgtagttgcgaaggtacgttgttactttgttagctatgaatacaatgacagtaccaactacagtttgggatgccacatggaagttattgtcggatgatatagtctacaacagaagaagggatttaaatattcctggtaaatttatttaatatctcctattcatattttttcttcttgcatatatattttacattgtcattttttacaggtctacaaatcgaagataatgttttgagaaatctctgtcttattgaagtggataagttacttcaatcaaatggaagatctctttcaaactattcttccattccattgccagtggcatgatgtgtttgacttccagaataagttgattgttgatgtacacttaactacgatcaagttaagatggaaaggatccaccaggaatcaatgaagtcgttgacaatataactgtatacaatgacattatagaggcaatcatgattggatccggtggatttttttttccttatatggttatggtggcactagaaaaacatttctttggaaaactttatctgcaggatttattgtcttaaatgtggcttcaagtggtattgcctctctgctcttacctcgaggtggaaccgctcattgtacattctccattccattggtcatcaatgaagaatcaacttgcaatattaaactagggagaaatagatcaaaactaatcatatgggatgagacacccatgatgatgaataggttttgctttgaggcttttgacaggacaatgtgagatataatgcatctcaaaataaggataatattgataaaccttttggaggtaaggtaattgtaattgtattaggtggtgattttagataaatattgtttgtcattagaaaatgatcaagacccaagacattgtcgggttgctataaatgcatctaacatttggagaagttgcaaggtattgagactcaactttcctaaaataagatgatgtctactggtatcagcttattctttaaatttcagaggagataattttcattcattttatattttaaatgatgattagtgaaagttaggaataatcttttatcttatgtggacatctatgacctgtatttaactatttgataatatataaataaaaatattcttaacttttgactcactaaaacaattggatgtctttttttattttattctcatttgtatttgtttatgtttatccattatactattttagtttatgttcaaatcattttcatctataagttcgtaaagtatacattttaaactataaaaagttatacatattttaaatttagaatggtttaataggaatgaatttgagtttattataacatgtgcattaaaattgtatttaacatatcacgtactatattcaacaataatggtttaatatattaaataaaattttgctaaaaggtttaaatattagataatttctaatacaaaggttaatataaaatatctcataaaaaagaatcgtaaacgttatcatgcgcttggtaaaagtcactcactctaatatataaaatagtaaaataccgaaattaaaaaaaaaaaagaataaaaaatgtagagtatagggcagtgacagaggaggagaggataggtagtggtagcgctacaagtagaatatgagagtgtatttatgaatggaatttaagaagggagagaggtgagaattttaaggagaatgtaatgtaatgaggtagatgaagaaatgcagaaggtgacaaaaacaaaattaagaagagaaagaaacacgtgttgagatgttgaagtttctcttattgtatataataattgatgtttgatggatgtagctaggtgagtagacaagtggaaatgtaagagagaggcgccgcccgggtgtccctatggcgtgactagtgggacccacttgattaaaatgataaaaaagaaagcgcgtgagttgatgtattgcagggctcgaggcacctcgtgatgtgatatcatatactaaacttcctctctaccttagctgccttccactactcttcacccaaaaacaattatttccacttctccactctccatcattaattcattatgcatctattactactaatatcactctctctctctctaaattattatttttttaaaatttattttaaaatatctttagtataagattttaaactcaagatgtattttttataaatttttcaataaaaaagttaaagaaatttttaatataaataataaatttttataaaagatatcttaagatttatacattactcaaaatataataatttttcttcattttttctctccttaaaattacaaaataagatttattattaaagaagaaaaaaaaagaaatattgaaaaatctttaatcttatctgatacaatagaatctatcaaaaagtaatctaagatcacaatttgacatctaccattaaaaatactcttataaaaactttaacgaattaccaagataattttagcaacatatgttttttttaattattcaaatttattacaaatatcctacttgtgtgtctgcaatgtcaccactttctccctccgtttactttctcttttcctgtctgccttctcgccctcagtaaaggcacccaagtatccattttcctttacgtctccttccgacttccttctctctctctcactctctctctctactctgatttttccttttcttattgaaatttaaaaaaaccagtactatcaaacaaatagtacatctttcaatgtattattattatcatatttttttacatctaagaaagataaataaaattattaaaattaaatttaaaatattattttaagctattctcttatcttataaaaaaataacatttaaaattcaacctaaaagtaacctatactttaaaaataccagataactttaaataaacgaaaatctttaaaacaacaaaaatattaaagttattaaataaaattattgattccttcgccgatgacatggactgaaggaaagtatttctataatgaatttcatttcatttttattgaaaaacatcacaatttatttttatttggtgtatttaagttattttatatacattttctttaactttctataatattaaataaataaaatattttgttcattttattctatattaaacaatctaaaatctgtcttctaaatttttatttatttttactctcatatacgaaaggagattaatggtatgtttggagatgaattctaccatgtaaaaagttaaacaatttttacggtagaaaagtaaattttcagttttaaatttttagtttagatttattgtttttttcttcttttcagaattaaccctccctctctattgcaaatttgcgtcccttttctcaatcctaacccacctctatcaaacctgcaccaccatcacacctccgtcaatcctttgcaaccaccacacctccgtcaatcttgcgccatcactacacctccctcaatcctttgtagccgttatacatctgtcaaataagcaaaaatatatctaatgactgaaatttttttcataccataaataaaatgtttaacttgttgcacggtaaaattcgtcatgttcgaaatggtagaaaatggatgtatctatagtagataaatggaaatagaaaatttatctttacttatatggtttggtgcactttaaaagtgaaagaaaaataaatttgtgacactcatatctaaatgcaatatcctttcaatttgaaaaaaaaaagttgaaaataaggtgattaataattaaagactaaattattcttatttttacacacttaactataacatttttatttaaaataaagggtttatatcatttcattaataactaaaacactcatacattcatgattcatgaatgacatgaaagaaaaataaaatttaatggacactccaaacgtttatgtaacatctagaattagaaagagagtaataaatatagataaataaatgttggttataatttttaacatactcttttgaatatctttgttattgattgaaatttataataaaactcaatagatccaaatcttatttattgattttctttcttgattttataatttttaatacattttaactaataagaagaaatgtgtatggaggagtgtttgaaagagtgtgtcttattaccactcctcatatagatatgataaaatcttgatttgataaaaagaaaaatagaaaaaatgagaagtgttactgttataggatatttaaaataataaaaatatttatttatcattaatttaaaaagaaattcggactataatacaatttaaacactcttaataaattataagtgacttgatttgtttgtatgtgaattaagtatttatttcttaactaaacatggcttttcatttgcgccactataacagaccttgaattctctaggcgaaaagcgtttttctaggttttgtcgattaatttacactgaaatagatgtgagagattgattgggatttcatattgtaaactgaaaaagcatcaactatcatacttttgaaacgcgatctttcaacatacctcctattggaccctaggtttaggttagagggccacaaaataaccctgacattagaggcacgcgcactttaatgaaatgccgatgttacccacaaagtgtcaataaaaatattactctagtccaatatcctttttgttatctgtctagttcttaaaatttatttatttatttagtagtttttaattttatatggtttttctatttttatttctatctactttttgaatattttactttctataaatataaaaatataatagtaataataaattgaaattaattttaatataaataaacacattattaaatttttgaataagtaggcaaaaaaaaaaggagtatataaaataagaatttttcatgagtgtcttaaaacaactaaattaaaaaacaataaataatgaattaggtttaaaaatgaatgtagatctacattgaaaatcacaatgaaaatatgtaattaacatttatttgtaaaagttccgcacttttaattccttgaacaatgcattagaggcatttgccagtgttctcatcacataatagttatttaattgtgattctaataaaaaggcaatgagtttgtttcaggcaagccaatccaattttctaagtgtgattaaaaaattgtatttctaataaataccatctaatatttaagaatatagaattatatgtaattttgttactcctatttttaaatatatgtaatattgatttcattatttttaaatataaatatttaatccttttattttttaaatttcataatttttatttctttattttaaaataaaatatttaatcatccagtttaataaaatttataattttagtttttttttatcaaattcaaaaaaatgttgattgataaaaattaacttcatatgatctaaatttagtgatctgagataattttttaatctatgtcatgattaatatatgtgttaatttcttaaccatcaatacttttactttgaggaaaaactcaaaattacaaaaatataaaactatcttgatgtgaaaagacagtgatcccagcttagatcaggcttgcgaaataaaccgggccataattttctaatgagtccacgggccgaggcccatttgtctcttgctttctttattagttatctttccattgtttttttttttttttgtgagccgtttaattccagatttaattaatattgtacaaacttagattaatataaaaaaatcaataggtcgaaatttatattgcaaatataaaatcagttttagttttgagttttgagttattctttatttttaaattttaaaaagatgttacaatttaaaaataaataaaatgattgaactattttgtcttatgtcgctctaagatgaaataatgttgatgataaaggtaatggagtgggagtgacaataataatggagtaacaataatggtggtggaatggtaacgatgataataataattgcgaaataatgatgattatgttttaaaagtcgttgcaaaacttctcacaaaagatgttagtataatgtttgtaaaaaaaatgcagctacaaataactttttttttcttgtagtgcacgaaagaataaattacattaattatcctaaagttttatgaacctacacaaatatttcctttattttactcctacactaatccttcttaaattttgaaaaatatacactgatcatgctcatttatatattacactaattcatcttaattgtttataaaatattacaccagagtagcttgtgtaacacaagattattgtaaaggttaaaaaaagtagagtattatttatgtaattttacaaaactttaaagacaattaattaaatttattctttataaaatatgttgatatagtgagaataagtcaggatttattttactatatatatatttaataaagttaataaagaaattaatgactttgggggagagaaaatgacaagtccatgtactttttagggtttttctgtaccaagttgattagttggcaagctaggaaagctacatgaatgtacaatgtgtagccttagtcaaactagggaggcttttgtatagcgaacctggcagtcaaaattttgtacacagttgagtttgcaggaggaagaaagaaccatagctagctaggtatatatatgaggccttgtttgccaatctgataattaagcagtgacagaagaggaagaagtttccttagcatggattcctataaagtctgtgccagccacatgttcatctttaagcaaaaatatttaaaaactaattgaaaaagctatgcatatgatatgatcttcccgaaaatgcatggtagctaatgctaaatcatctagaccgcatgtattcggggatcgaaacacacacaaaaaactggcaaaagcattgtcctacttatatcttcaaaatcagagatttaattaccataaattatcttcaaaatcagaagaacatataagaaattaatgaaattatatatgctttctcaataatattaggtttagccgttaatgttatgatactgttttgaagcgccattaaaaattcgggttggaaaactacaaaacttatgattttctaataaaagtcatcgaaatttgaattggaataataaattaataatatttggatacttttcattgcagtatttcaaaaatacatttttttacattatttttttcaaagaagaaaatggtcagtgaaatactgcatataaaattaggagtatgtttcaaacagtcataatcataaatttataagaataataatttattattttacgcatattttataaggtttttacataaatattttttatcacattaggttatttacttttcaattctctctccctttgttctatatttttcttttaattataaaaagtataaaaatattgctgaataaaattcatcatttttaatgatattcataaatgaaaaactatacgaagatagatatacagacaaaataattggcgattacattattgtagtattgaaggggtcgtatattcctgccattggctcaacaatgatgggcattttggcaggctgtcttgcatgggtaaaggaaattaaagaaaggaaggaatttatgttagaacactgagcccacactctgaggttgctctgagcccctcagacagcaaaatctccaacaaaattcattttagaatgttaggacaaaaacccagattatgcattttttttttggaataattaccaatatacctacatagctataaaaataatgattattgaaattttagaattcaaggagagaattagcttcggcataaaaagaaataacgactatataaagaaatagaaaggcatttaaatgcttatgcttatgcctgttaggctttcttagacagtaaaggatctaagtacatgtaattaatttatattgcgagttgtcaaaaccaccacaatagtaagttgatttgaaaatgataaagaaaacaaagtactatagtttattgaaatatgttacttttgatctctcagtaacaaaaatttcttatataaacaaattataattacttatattttattcaatgatattatctttaaaatattttttatttattaaagctaaatatttttaatgctgaatattaagtttcaataaataataattttaaaaaagtgtatattttttaattagaaatcacataatttaatgaagttaattaatttctttaataaatatgaaatatatatattttacttataattaagacaagaagtagtatatatttatgatatgtacttaaaaaaaagtaccgtcacttacacttgttatgtttatgatatgagtcacatgttatttttcatcaaacaatgagttgtgttcgtaattttgacccaccagtcaccacaatttgtccttccaggattttaggtcaattagactcacgaagtaaggagtatttgatgccaatcacgccctgcaagaaagtgcattttaaatgttttatactagtactagtacatatatgataaatgaaagagaaatgataatgaagattatattaaatggttaaaaacaatttcaatacaaacaagcataataatagttcaataatccatggaatggtgatggtggatggggaagaattgatcacaaatgccgagaaggtggaggatgagagatattggttcctggatttgagtatttctaatacttttgctcctttcattcattcataatttctggcacactgtttaggggtcaacggtggataaggattggacggtgatgcgacttttgtagacatatttggactttacgtttgatgtgactcagaagtcaccaccatgcttcacttcgctagctgtcttccttatacaagttgcccccacttgtgttaccctattctctcgactctcatggtttccttttaaatcaaccattgcaaatgttccattgtccttgtagtaactacgaacttgtaagttgtaacccacctcgtttaaactcttcctgtatcgattcttatcaacacattttttttttcctttcttgaaaagcaaaatacgatgtattttgacagatagaagtcataaaattaatccccaaaacacatttaaattagaagtgagtttttcctctcttaatcaaaatttttcatatttacaatctgaaaatctaattactcttaacatgcttaaaaaattgaattatttattaattatactaaattttattggtcttttaaatacactgttatttataatataaagatttaaatatgtttttgatttttataagttaattttatttttttaattttgatacttgtaaaaaaatattatttatttttatttcttgtaaatttgagtttttttttttaattttggtctctatgaggtattttgatatttttaattttgataaatttatctctttcaattttttgtctatgtaaacgcaaaaactataaatgaaaaaaaaattaaatcttaaagagactaaaattaacaaagcacaaattcacaatgaatgataatttttttttacaaaaatactaacttataaatatgaaaaacatatttaagtaaaaaaattatcataagactctttttactgcaatttactataatgattataccctacatttaaaactatttttatgatatacccttcattaaaatacgaagaaatgaaaaataattaaatcgttactgtttttttaattatacaagtaaatggataatgtagtccttaattgtgatttgttgcaactttagtttttagaattaacaaaacttcgaaaaatctttatattataaatttgtactcattttagtccaaaattacgtacatgcatttaaatattaacatatacttaatgatcaaaatgatagaaatgattaaattttggaatttagttgaaataaattacaatttaagttttttttaaaaaaaaaatctaaagatcaaagtcacagcgaatcacaattccataaactaaattgttcatttactctaataatatcctaaaaaagaaagagaaaaaaaacaataaatggaaaaacaagctaatcatatggtagttgaaaaataaataataaatttaaacaatattttgatacaaacaaaatacttttttgtatttcataattctaatattataacctgctctggccggacctgacttagtccaagtctagtaagactcgatatactccatctagtcgaaaacaataataatcttcgtaagcatatgatggagcaacttacatgatgtaaggttaaaaacacattctaattaaaatattttaaattactctataaatacattttaaggaagtaaaagatttttgttattcagacgcataaaaatagattctcttacaattgttaaatatgttttcatatgatttttaagattttttttttttttttaacttcttaaccacactctagtaacattaattggttggcaacccttaactaaattatttatttattaataaaaaaaagccttgaaaacacaattattaacattctcaatttttaatcaacatattagtatgtttggttcaagtaaaaaaaaaacagtagtattaagaattgtacgaagtaacacattataggtaaagttatggaatacatgaaaatataggtaggattgacttgatggttaaaagtagaaaaaaaaaatcatagatttaaatccttcttaataacaaaaattaataaattaatatttttaatattttttttttgtaatttacacgcagacagaacattagaagatctttgctaacatataaaatattgggtctatgagatttttattacttatatgcgtttaacatgtctcttttctacttgacgcgaaatctccacactcatgtttaacaatctaacaggaaaggctcctgtttgtccccgtcaatagctgaaatggctattgaaactaatactaaaaagaaaaattttatagcaactatagcaacatttattagatttctaacatttaaaaatgacttaacgaaaaatcctcttctttcagtatttttggaatggattatttaatatggacaggagattctctccaacacttcagttacttatataagtatttgtcgcctttagtttgacgtcgagtcaaataattgaaagcaagcatacactttatctcgcaatgcgtcaaatctaacacgaaattatatatagtttaaatccacatattcagaattagatcaaatgtttgatttagaacccttttcccatgtgaattaagcaggaaaaaatgatagtagtattaaaaaaaatcaaagttatatagaacatagagaatgtgagagttcatagggaactcttaactagttgtggtttgcattagcttgaaaactcctctagcgctcaacattgtaatttgtttttgacttacaacgtgtttggttctgcatcagcgaccctttgacacacactcgtaactccaaagctaccaagacctacttcctcatatttgaaagatgagccttgaagagagattatagaatccgtgttggttagttattttcaaacatgcacttaacacttttaatacttggccttgggataatgtgagaaactcttcatcaaaatagagtcggataatgtgagaaacacttaatattgaacctattctttaaaacacttttttgtatattatagtgatcgatgatattctgttttttcttctcttacactatttagattctgtggaacgaaatcttctttgtccttccaaataggtcaagaataaaaaatgaagaaacgaaattaacaaactgaatgaatttattagtgtagattacattccacttaagctttagccacatgacagtgtgtacctatttttagatatagcagttggtcattaactcatgccctataatttatttttttggcagcctttggtttgcgtttggggtctaataatgatatacttactcggtttgctgtgctactaccctgtgtggaaccatgcagcaactcataaaacaaagctgttggaaaggaatctgagttgcccaaggaaaattctatacagttccacgtattttattttattttttttaaaaaaaatacaccgagtggtataagaaatattattttattttactgcagatagaattagatcgattttgaaaaataaaattatttgacttaatctctttaattttcatatataaatcattcagttttaaatctgatcaatttaaaaccatttgaattagattgattttttactttaatcttattttactttttgggagaaaagattaaataaatgataaaaatatataataaaggataacttaaaatattcaatatctcctttataagtcaataataactaatggtagtataactctttaaatatgtagtattaaaagtaaacttaataattatacatatgtacgtaccttcagtcaaatagttaaaaatatttatctttaattaaaatgtttttataaataaatatgttataaaataattttataattataaaataaaaaatatataaacgtaaatggtataataaatttataaataaaaacgtatatacgtatatgcatatataagtttaatttggattgggtttgatatcttattttcagaagaaaaaaatattatgatttattatacattcaaggatatttattgtttgagtaattttcatatgttattaacatgatattttactcttaattaattaaaaatatattatatataactttttaagtaattattataaaaactaataatattatcatttatagtctaaataaattgttattattttatgctacaatttcatattactatatatatatatatatatcttcatttgtatgttcacttttttttaataattatcaccaatttatgcttttagattaattcctttaatgaaggtatggacaactttaaaggtactctctctttgatacatttagatccatatccgttatataacgcttatataatattttcgaaaataactattttttaattattttaagtatctgtgtttgtgttaacatttacttttcatattaaaaatataatactggtatatgttatacaactaattttaattactataaaatatttctattatattaattagtataaaaagaaaaattcatagccaattaatgttaaattttgaggaaaacaaaaactaaaatatagtttataatatggaaatcattaaatataaaaaaagtatgttcaacacaacaaagtcgacctcacatgccaaaagtaaagtgaaggtacaataagttttttcttcttcttttttaatgaacacggtacaataatttacatccatacattataaacatgtagctttactgctatttaatgcttaattttatatttttgaagaacctttaattattgatattgattttgaatttttttcctgtaagttatgttttgtttttttacataaaacttttcattgatattcttaatttaattcttaaatatcaatttcagttacctgtatgatttttttttatattatatatactttttctaacactatgaccgaagttctgaaacaattatactttgttcctaatgattacgtgtagggttaggtttcatcaaatcggcctgctaatcaacccaattaaaataggttagattgagttaaatttctgtaaatttttttatcaaattcaaaccaaactaacctaatagtgagttgggtctacaggtattggaaattaaaaattatttcataatattttaaaaatatttttttatcattttcaaatgacattttgatataattttttattagttacattgtactatatgcattttgattttttctttctttcatacagtttcactataaacacaaaaaatcatatgtaacaatgaagatgtgtgcacgttttgatttgttctaaaattaagaatcctagataggataagaaaatctagtatacttgcttgtataattgtgtttggtgagtgtgtgtgcgtgtttttctctattttttattttttttttgaaaatatccaaaataataaattaaaataaaaaagtatgttacattaatagaattgttgggttaatggattcaacaccaaaacccgacatccaacaaagaacttacgttttttatttttatttttcactgatataaacaatttgaaagagtattgaaggagtagagttcgaataaaatactcaattaatttatatccttattatggtattaaaattctcattgccttttgcagcaaaatattaatttagatcgtactatgaaaacaaaagcatagttctagaagaaacttacgtgtttgttgaaaccataaagagcccatagagacaattatcagcatatgcatggagaggaaaacaacttgttttggtggtagtgcttttgcctttttaattttgcttgggtaggagttaagtgggtgatcatgcatgtatgtacccaaaagaatttcggtcggtggaaattaaagctaagctactcaagtaatacacttacgattataatatggtgcacttttgccctttccgattaaacggaaaacaaaacgcttctccatttgattatgtagcatgatgaaatccatgccactagttaaataaatagtcagcgattgcatccatgcatggttgtcaaaatatatatatttttagagcatcaaattataatgtatttaattcgtaccgagcctacaaaagaaaagaaaaaactgtgggattaaaatgcacgaggaatcatgccattaatataaaatagtactatatagttatcatataccatatagttttatatggtttgcactttgtagtaagtattaccaataatacttttttttttctagactagaaatgttttgattttcatgtgaaaagcaatgagatgcatgtgtgataatctgatgggtaattggaagaaccgatgagatgagaaagtgagaaagaagcagagcccagagaggacagtaacgtacaaacaaaacgatagacagcactaatgaatgtgcgtttgtttatgaagaaaagatgctgcttttgtgcgtcagtgcaataatctttgcaaagaagggcaacataaatattactaattaaagactttttaggccaaacaacaacaagctggctttaagcacagttagacaatggaaaacacggtgtgagaagtgattgcttttcaagtgcatcattaacacactttgtataagagagagagttttagaatgctttgaaaaaagagggtactttcacacacacgcttacaattcacaatatcaagatgtgtgagagagaggaatgaattgaatgaaccttgagagaagtgtgtgatgtgaagactgaagaggaaattaaactcgtggcccccaagggccaaacaaagagagaagaaggtgcccaaagaggacatgaagaggcattgcatttataacttttgctttctcttctttcacttttttgggtgatctatgttatttttcagcttaaaaaactaatgatttatctctttttttattaataaatattaattattaattttattaaccgatgatatcgaacatcttttctttcttttctttctttctttccttaatccttagaaatcttatatctccaataattaatcccttatagtgaaacttattaaacaaattacaattttttttctatatacataaatttgaaaactgaactctaaatacttgtttaaatacttgattatttatcaattatataacacaaaattgattttcattctttcacgtgtcttatctaacaatgattctattgcttttcatctttgggccgctcttaatcatcttctatttagccaaaagtaacacagctaattaatcgacccatgaagtgaccttaagacacgagtttatcacaaaaggcaaacaagggaaggctttttcatgttccaatttttatttttggtttcgtgttcctttgttgtttttctcatgttaaagtttatggctaatttactcacagccaccatgcatcttacacgcgccaaaacgctcagaactttttcactgggccggacaagtaattaacttcaagttttattttttttataaaagtgttgtattcatactattcatagacatattttacgaataaagtttttatcacgacacttttataaactatacagttatattttaattccatttccttacataaatatataatgatattgtaacaagaaaaaaaatattaaatttatttagaaatttaatagtttttatttgaataattcctaagtgtatttatttaattaaattgacttgatcattttgaaaaaaaatattaatagtaaatttatacatgttacatcaacatattcgcaacattaaataaaatataatgactatatatatatatatatatatatattatctacataacatcaagtttataataagttcacaatactgaatggaaataaaataacttgaccaaaaaaattctgctatgactattttctaacataatattgtcacttatatatctcattcagagtatacttttatagcaacaaatctttcacctgctaagtgcatgtttgacaattaattggtggtgcaccaaacagagattggccaacacatcttctttcttacaaattggatctttattacaacacggcgttgcaacaaattaaacaaatggaaaagcaaacatccctaattgtttatttttttaatttcaggcttacattgtttaattgtggctgcattattgatcatgagctctatatataaagattcgtgacagtgtttagtttcacattttagacatgaattgtcgtgtttggggtgaggttttaagaaactaataactataatttttacgttcaaattaacaccacaaaatcaacccatctggttgaattgccagcgctgactctcgttaattcatcttctccacgtgcagtcacaggccataccatctaatcccaaggcacccgccaacaaactgtgccattttgaacaaatttactgtcactggatctgctgctctattgtcctcgttttatgctgcggattcgctgatgatagagaatcttgtttctttgtcttcatatctttcactttcatcacttacctacatgaatgtacatatgatttttttttttttttttttatttattgaggggtgccatatatagtagcagaaaacacaatttctggtgttagcaatttgccttgttcacgtgagtatcctaagttgggtaaatgttggtatacgatcgatgcaaaaatttgacatgagtaaactgtatttttttttaaaataataataatagcaaaaacttatatacaaatcctagtaatatagcttttctaacacaccttgattaaaatttgttagaaaccaatacaaaatttgttagaaaccaatacaatgtgtgagtttacatcatatttgatgaattttactcataattttataattcttaataaattttaagtaaataaaaaatatttttctttggtatttcaagttacaaaaattatgtgaagtaaaaattaagatagtgaacgctgtgtaacattcagatgcaaagtagcggaagatttcaggtgcttaactttttttgtttgtgtatagtccttcttgtataagaaactatcagaaaactacataaaatgtaaagcagcaagcacattcatttcaccgaaaaatcccatatacaaagggaaaaaggagaagcttttgtgtccaatacgtgcgttggacgattcttagcagtacccaatatgtacatgtgaatggcattaatatatatatatatagttgaggtacaaagggtgctatgaaccacaagaaaagtctgtttttgaataggctttaaaactagttaatatggatcggattctttgcttgattagcagcacaacgtacgctcatgttttattttttgtggtttaataaaattccagaagaaaaataatagtaaaaacataaagctagctaattaacgataagaacctaatacatattgcataaaatagacccaagatatgctgtaaaacacaggaatataacttaattattcttcaacattaactaaaactatatattttgaatgaggttatattaattgaactattaattattttaaacaaatgtacatttattaattatctaaaatatgtattaaaaaatagaaaatatcacatgcattggccgtactagaatgaaccttttcatctcagatcaataagagcttatgcataattatcttggtgactctttcaataattaattcataagttattcttaatataatttatgatcgattgataatataaaattattctatataattagtatataaattttaatcattataaaaaaattgactgtaaaataagttaatgctcatctaaccacaaactcatataaaattcggttggtttgatttataaaggccgttctgtctaactattgtatggtccagtctgaatttacatctgatgatcagtttgtgtgtttcgtattatttcatgaatctgactgtgttaagaaaaaatcataacattgttttgtcctctcaagtctcatctgaattgcatcgtaactcatgagatattctttttgtctacgtgggatgaaactttttcaaatttgaaagatgcattttatttcaagcagaggaattttcactgctatagttttgtacttcatctttccattttagtaaatataaataaaaatattaattttatgtcttctatcaaatgtctgtaaaaagacaactttggaactgcttatgtttaacaaaaaaaaaccaaactagcaaaattatttagcaaaagcttcccaagctgtctgtggcaaaaactgtcatataccaccacaaatgtaatgactttacttgaagtaaccgaagcactccatttcctcccatgcaagaagtattttgttttatagataaatcattaaaagctaatcttgcataaaaaaagctctataacactttgagaaaagtataaaaggatgaattgttactcaatttttttatactatcaaatagaatactttttttagtttttataaaagttttttttagtttttattcatttaaaaaacacactcatttttaagtgtttcattgggattgtgttttcccttcctaaaaccagtagtaaattatttaaaacaaaaataagttatatatagtaagtctcacttgtgaaaaaatatattattatatattagaagaaataaattttacattaaagatgtatgatgataactcgaaaaatatataaaaaaagataaccaaaacaatctaccctaacaaaatagcttctatacgtatattaacttggattactgaaggaagataaaaatacttttttttagggcagaaaataaaagtacttaagaaactcttttagtttttcccctgaaatgtattttagaaagttacaaatggtatacatgtactatatcgtgtcatcttattatttcttgatataaaaaaaaatacaactaagggtattaattaaaaatttaaaatataaatatttttattaaaagacaaaaaattatattatttatattttttttacgttcttttgtaatttatataatatacattttttagtttcttgattaatatcttaagaatactaattaataagatccttgatttgtattaatcaatttacccgttatactcaagctgacgatatatacacaaactctaaaaaaaaaaaatggagtgaaaaccttaatttttttgtcatttcagtatgaagagaagcataaagcttgagttcagattcaatacagtgagagcttcaatacaagcttaataagtgccaaagtctacaaaagctattgtctagttacagtaatgtgaggtacacaacaaccaacaccagcaagaccatcagtattttgttacgaattcaaaacgtcaagttatttgaaaactatgactatttttatttagttacacattttatgtagttaattgatacaggtaaagaagtattaataaatggctggacacagacaaaagcgccggtgtgtattttttggaaatcttattgaaatatatatacataaactcagcaccctaatcttcaaccattttttgacagtcataaaaaacaacaactaaatcaataagcaaaagcttaagttcgattaactgtcatctgagcatatgcacataaattgcaaaaaaaaaaaaaaaaaaaaatcatagaaaaactctttgtgtgtaatttaaagagagactcactcaataaattgatatctgacaaagacgatctaaagaaaaagaattcatagatatggggttggaaggactctcttagtaaaaaaggaaaaagatatggatgacaccttagattatagactacagtatatagctgagtgctactcaacaacatggtttaattttattctcaaaaataaacaacgtcccaaattacatgtgtgccacagatagaacgtagttgctgcacgcgccgttccgagtgaagtgggattgagacgtaagtggtgtttgtgtaggtattctggggtgagaaaatgcactacgcgcggggagtgatactcacgcgccgagcccacaagtaataagtggcgtcatgtgagtttcatagagggtccataaaattacaaaaactagagaacaaaagtctttatactctctcttccccttcttcttctctctttctactactactacttattatcagagcctgataattggagagagagagagagagaagagtctgtgtgtgggaattggaaaagaaagaaaggttagggaagagaagagaagaagaacccatttcagttttcacttttcataggaagccaagaaaaagaaaggacttttgttttgagagataaatgttggaagaaaaagaagcttagctaggtttgcgaaggaaggagatgatgatgatatgaagagagagaagaaaggtcggcaacaataacaaagcaaagcagagagaaagaaaaaaaaaatatagatagagagagatagagagaaagagagagacacagtaagtaagaagtcgttattgcattttctcattcactgctcactctgcactcttctgctggctggacccttcagaaactgatctttctttctctctctttcttactcgaaccaaaactttttcttcctgtggaaaaaagccaaagtgacagtagtagtagtagccacaatagcagcagcagcagaaacagaagaagaagcagagaagttgttcgttttcccttccttttcatagagagagaaaaatctaagtccactccattcaactcccccaccccaccccacctcaccctaacaatacaacaagatctcatctcatcttaaacactaaactccatcaaaagagaaaacttctctcttttcttttcctccaccaacaaattctttccctgccacaagaccccaccccaagaagaataacacccacattagatacaccctcatacaaaataatatatatacaccaccacttacacaatagaagatctatgcttctgtagttctatagttctacacttagttctgtctttccacctactctacaccaccacttagacaatagaagatctatgcttctgtagttctatagttctacacttagttctgtctttccacctactatacaccccactttttttttttttttttttaacagaagaagtaaactatatattattacttatattgtctcttgatttgagaagtaatcaaggattttcagttgtggctactacaaggaggttaccttcagattctggtgcctttgcggactgggcagcgacagcttcctccggtgctggtggtggtgccggccgcgctgtccccgtcgacgacctctccctcggcttcaatgcgggtcctactgccgccgccgctaccggacccaccgccggaatgtggtccaccgcagctaggtcaatcaattaccccgaaatggggatgttcgtggtggcgccagcttcttccttccaccaccaccaccaaccgccgcaacacgatcccgccgtcatggcggattccctcaaccccgccactgcactcggcgtcggtgtcatccctctcctcgctgccacgccgtgcctggaatccgacaacaacaacatcctcggaaataggacacgtggcggcgagggaattcagctatggcaagaccaacaacaacaccatcaaagccactacatgaagaagcagctgcagcagggtcttctcgaccataatagtaacaccagttcggggaatttggttcagaacagtggcgaggtaactgcttctggaactagtagcggcggaacaacgtgccaagattgtggaaatcaggcaaagaaagattgtaccaatagaaggtgcagaacctgttgcaaaagccgaggctttgattgccctacccacgttaagagcacttgggtccccgccgcacgccggagagagcgtcagctaatgacgtcggccaccgcggctgtcgccggctccagtggctccacttccggcactaaaaaacctaggctcattgcttcacaaaccacaacaacctcccacacttccacttccaacaccacccctcctagaagcttcgacactagctctagccatcaaggtttgtgctttcttttcataataatgaaatgattttattttgcatgaatacacatgtattaacataaactcatgcattagcgtcaagggggtctgccgttgagcagggttcgtgatgcatgagttattgtaaacctctgagactgtcttcgattctctcgggaaaaaaaacctcatgcattagcttcttttgggttggtgcataggcatgggtttgagagttgaaagggtttttaaggttgttaattgtgatgtgtattgttgaattgtgtgcatcagatgcggggttcaaagagtcattacctgggcaagtacgtgcaccagcggttttcaagtgtgtaagagtgacggcagtggaggatgggcaagatgagtatgcatatcaagctgtggtgaagattggtggccacgtgttcaaagggtttctctatgatcaaggggtggagaatagggatgtgtatcctaacctatctgagttgcatttgggtggtggaagtggtggtgcaggaagaaatggggtttcatcttcatctccaatgatggatcctaatgatgtttatgcagcttctggtggagggttactagggggttcttcagcatatggtaatccaatgaattgatctgaaagtgtctgaaaaactgtctttccgagtgcaagatattagtagatgggcttggagaggctgatgatattttaattttcttctaggctttgtacctttattgcatatgtcactgtttttctgtctgccatttttcaacttgattttagttctataattctttctctcgcccaatctggcccttgtcattgcatgagatcatcagttagtgacaaggaaacctcactatcttctaactgttaaaagaaattgtttcttatgtactaaatttaactcaaactggaaagcaaaggtgattaaaacttattttacttggttcactattttaaattttatttttagttaacattattgattgcaagcttgcaacaattatatcaacttttcttttgaagcaaatgccttttgttttccattttactccccctttattttcattgttttatacttaaatttgccaaaggtgaaatctacagtattatacccacaatcaattgctacagtataaagcgtatgataaagatgagtttatatgtgttaataacttctgataattgttattgatgtgcgttcacccctttgcgttccagatgtatttttcagcattatttactcgttattttggagtgcttccattttctgaatagacataaacataatacattatttaattccttagttctatatgctaatattaaattgtcactttgtgatggctcagtttgttttaaatattgtggaataaataaatgttgagtttacaagtagctgctgtgttagacttgagcattagaagttgttgtaacgtcaccgtcattgtatgtctgtccttttcatcctagtttattggtcatctctgatgcgtgagaaacctgcaaagtttctgcattcatgaagacttgatgtactccaatttccttttgttctttgtttgggatttgtagttcaggcaataacaattaccgaacctttcatcttctaacaataacagtcggttttccagtgtgtctagacaaaattaaagctgtttaattcttctgttgctcaattttggtgcactatggtgctaaacttcaactaccaatatgtgcagcttgagttggtgtcacatttatttcatttgcaatctagacccattttagatttaaaaagccattcctttctcttctaaaagattttaatagtagtatttgtaatattattctatagcatgccgatatcctagaacttgccttgtatgttattttttcttatcaggataagttgatgtcgaggttgcattctcagcttttatatactgtattgccggagaagctgcagatgtgtcacttatttttttggctagattcttagatacggtttccgaccattgataaacaaatgaatgattgtctctattcattgcatatttagattatcttttcctgcacatgctgcccccttttagttgtctgaatatattttatatttaggacgattatgtcatgtggattgcaatacagtttttatatatatcttgtttgtcttgtgtttgctatgatgctacatatttcactcatgaaatatccatgaagcataggattgcttgtgttgtggcatggtatgatagtatattaacaaactactatggacaatgcattcacatttttgtaccagtggttttttttttttttttttggtggtgatatttcttgaatcataatgctgatctgtctaactcttcctatcatgtcaataaaaaagcattcatttactttacttttccactgatgtagaatcaattaccctgtctttagttaatttcatttaagggttgtgtttggaacaatttgtttgtgccctagagcaggcatttagaatgttgatacaccagtgggtagttttagcttgtcttgtgctggcaaattgtttttcctttctgggatttgggagcatatgtaaaaatatgttagcactatcatttgttttcttctccattgtgaatgattgggtaactagtttttctttctttgcgtggggggcctccctttatctttgggtattttttggtagaaactattatttgatacagcttcacatggttggtgtaattatgttggaacattaaggtacatgtctgtgctggtgaggacactactcttgaattgctcacatttaagtacactagagttttatgcgtctgcttttagtcatgttctgcgaacaattttgttgtgcccccttttgctttgttgctgcctgtgatccattatcatgtcttaattttgtcatgttctgagacttttatttccatttaaaaaatttaagcacatggttatgcattttgtcttgaattttcttcactctctgttacacatgttgatatgcatttttgatactgggttttcatgttttgccctatttgtgcttttttgtcagtttaatttcttgacatgctctttgtagttccgaaattttgttgctttagttttgtattgtgatttcataatgtttgtggctgtgaattatttctccatcaaattatagctctgccatagtctggcttaagctcgtattatttgttccaaaggtctagtggtttctacgaaaatggttgtttatataggagttcgtgtaaagtcatttttgttacttggttttctccctttccctgggtttttagtatgtgattatttaacagctacaatcatattcttcaccgtgtattttttaaggaaacgtgtcattattctggctagtgtacgtgttgtatttttttagtccatatataagggtggtaatgaagtgattggaatgtgtggaatttttcttttgtgctcatataataacggattgttgagtgcttagttgattacttgatcccactatctaggtttacaatatttattatttgagaatcgtttatttcgtcgtgttatttttactttttgtgccgtatacgttcaggatgcttgtgtccgtttaattattccagggcacactcttattttgaattgaacttcatgaatttcttgggtgattgtatggaacagttcctttatgaatttatctagaatggcagaatcgaccgtgtttgaccaaatttgtcatatatttgtttaggattaatgcatatatttatattatttaccctaaaaaatgcatgtttaaattttttttgcaataattttcggagatgcagtctgttacacattctaaaatttttaagtttttattaaattaaaattttggtctccttagttttctaattttaaattcatgatttttatcttcttaatttttaattttttaattgttatatttgattaatttttaattgtaacatttggatttggttgtcctttataaattgtagattttggcacacctatagattattaactaattaatcaatgattgtgattaattgagttgttaaattaattataaattaaaaattataataaaagattattaatcctattttttttttatagaagtagttgtcaactgctaatctttattaggaagagttaagattgaaatgcagtagtcatgtaagattttttggaatgtcagatttttcttttaaatgatcacttcacataatttttgacaattaatacaagatcatatagaataaatttagttttattctagtgtgaaaaaaccgtttttactagatacgctaagcctctgaaacaaaaaactcccatgggtgtggatgtggcagcttgtaaattgtaggcgaaatggttctgtatgctctgcaaattaactgtatcctgtcttatgcgtttctgcgtagcttttgattttgtgcagtaggttaaggtcaggtgtctgattttgtttggattggatgataaggtaaaagaagtagcatattttatatgaaaatagattgattagaaatggttaaatattttatgaagttttgtttaacttatttggtctttacacatatataacaataatgatttgtggataccttaatcatgtgttgacactagtgagaaaaagaaataatatgaaaaaatatagttataataaataatagtataatgtgataagaatctaacgagtgtagttgtaaatagtttatggagaaatttttgagtttaattcttccatttttttaagtgtgattaagtttatatatatatatatatatatatatatatatatatattgtgtttgtgtgtgggagggagaatttgttaactcctatttcttagtatgagtttattaagaagttatagctagctattattttaaaatatactaatgatgtaacttgttaatacacacacattaaaaaaaataagtgtgtataagttaataaatattagtagggtttgttaacatagacactcttactttatagtatgagtgctttagcaaactaaaaaaccagatattatcttaaaatgcatcaattatataatttattaatacactcattaaaaaaaatgagtttgtatgctaacaaatttatatatatatatatatatatatatatatatatatacactgaaaagaaaatgatatatactgatgtgagtttgtaattaaaggggtatcatttcttccaaatataatgcaattaatcacgtactaaagttgtagcatttccaataccattcaaagtctgcaacggttttggatttctgagaagatttccttgatatggttccattatgaacaaaatttctttcatttcctaagcaaaagtttccagtctgcactcatgattgtggtcatttggtccgatttcaaaacatgctttgacatcaaattgaaaagtcgatcaattccaatgcaatttttcctttaaatagcgaggttctatcatacatgggtatttgggcaccagctccatatatggtaggaaggacaataaaacctgcacataatataattgacacctaaacactaggtatagtcctgtctatcatatgccaataccaatgttcatgtggcatctcaatgccatttcgtacgaaagggaaagaactagaagaaagagaggtgtaaagttttccaacattgttaatgggagacaaactaactttcacgtgaatttgtataaatatggactatgatttttcttataaaatattaattaaaaaataaagttggatggatgagtttgttgtgtgaacattcaataattagtagttaatgaaagtggtggggtaggagaaatataagcatacttaaaaaaatttatagcggaaagtagaatgatagaaatcacgatataagtgtgttttgtcgcatgattgaaagtaagtaatgaatgtattcgagttttaaaagcaatttatagaatatgcgatttttttattttgtatagaaactaataagcagaacctttgcctgcagaataaactatcaaaatgtactgtatacatgttgctggacttataatagtatttactgtgtaatctaaatatcttgaacagtgtatgacatttttttccgtactttttttaataatattgacaaataaaaatgcgtttaaccaaacttttacataataaaaaaaatctaactcaattagttaaacataatttatgagtgattgaaaattctttaatattgtattcaataaaaactgaatcattacacaacacatcaagttctcaaatttgtattaacaaaattaaggtggataaataagggtgttgatgtactattatgattttatacttgcagtaaaaaaaaacgagtatcttcgaatagttttatcactcttaaaacaaactattaacagaactaatcacatgtttcttcctgttttctaacaggaaactattttcttttccttcaattcttctaaattgttctaatatcatatctatatatcaatccagcaaaaaaatctctccctctctctctctctctctgtctatatatatatatatattaataaaatagacaattttattctttaacaattattttaataaaccatccattttataagttctatcaggtgggaaataataagttgcctatttagcaattttttattgcttatgtggtgtgtggccaccttttttaagatttgtttcatgttttttagcttggaaccaaaaaatttcaatctccagtctattcatttactagttgattaatgccctttgaatataataacttaagactaaaataatatactttatttaaatttctagaataaattagccattccatagcatattttctgaatttgacaatattccttgataaaacaatgaataaagatgtacgcaaagtggatgttcggtgcaaatgggctagtgctcgatgtgtaccgtgaatagtataaatagaaaaaattctgatgtagagcattaatgcaaaattatctttctcaaccattttttatcatttacaactttatttacacttgagccattttacaacttttcttataaattctgtcatttaccatctttcttttacattccaaccatgcatttaccctacttcttttattgctttttatatttaattaggaatagtagtataatttaaagcaatcacgtacacgattaccagactaagaattcatattggggaagataacctaatcctctagcaaatcttctgaaagagatccactgagttggttgttagtctttttacatggttgatttatcctatttcaaaaaccaacaaagggattgactcatctaaagttatgggagtgcactttagagattaaagtacaatagtaaccattaattaaaagacccacagttgagacttgagagtacaatttatattttgttgtatatttatttgatttgttcacaatttcaacagaagattctcacatcaacaattgtgtgtacactttaatctctaaagtgcatctactctcttaattttcatataaattaaactcttacctcttacctcttacctcttaccagtggatgttgatgaaataataaaactatacctatgcccaaccttaagctaaaactcactacttgaaatgcttgtggagacaccatgtcatcataattcatacctttgctttgttcgtaatatctttcctcaaaagagcttatagattgtgaggacattcttctaggatttttatttttatttttttagcttcataagtggaggcacagcctagttttttcttaagggccagccatgttgtttcctttttggtctataaactagggatgcgaataataatcatacatttgaagtctcctttttaacttgttggttgagtttggtctctccagcatatgatgaagcgtataaattaaacaatgctcgtatgaaaacttctctcaaggtataaacgcatctggctaaaatcccatttgaaacctcccttttctggttgattgagtttttgtctctagattggagatgtgaacaggatttggggtcagactaaaaattgcaaaggtatgaataatataatattataataagtagaatatgaataatataattctaaatttagatctctattttttttacccttcatatgccactatgtttttctccatctctttcctaagttttaattctctgaccatgccaagctttttacccacattgggtagtggatgactgggtgtagtgtaatggaattgaatattctctcaatttttacataattgtgtactgttgaaaattgtttatatcctcttttttatatataaatactgaatgtatcgggtcttgtcaaaatttgtaaattaatatttatgaagagagatatggaaagttacaaaacaaaagaatatgtgagaattcattcttgaatatataagtctccttttgaaatatgaaagaattgtttccccccctaaaattttagtgtaataataccaaaaaacatgtgatttcagtacgtaatttttttttttactaaccactgtcgtaaaaatattcattatgaattttttttaataaagtttatttatttcttggacataacggataataaaaggaaaataagtatggaaaaaatatgttcataacaaaaccgcaagaagtacgtttaagaaaaaaatgtgtatatttcagcaacataccaccctgctagctgaccatcacagtcaacatccaaaattttatgttatctatttgaataaataatacttttattatgtaatttaaaaatatttaatattttcatctaattataaaaccgttatataaatgataagttttttttttttggtttttttctcatatattttccttgagaaataatcatgttcaagacatgattgtacattaatatgaacatcttttttgacgaacatttaaaccttaatgtatctcattgtaagagattaaaccttccactaaatgtaatcttttgttggtatatatcgaatttaaccgtttttatattaattactttaaatatcttaaaatcatacaaaaataataatttttgactgattcacattggaaaaacttctgcattaataaccatacatgcctattataaactttgtctatattactctacgcctaggtcactagtttgttctcttttattataaaagcttatcagtaaattaactttcaaaattattattattattattattattattattttggaatgtgaatgggtgacttgaaaaaattaaagatttattgatataaaaggaacatgaaaaaataggaaaggaataagctttttttgccatcaaaatggggaaaaagtggatttgggaaagtcttgataattaagtaagaattttttatacagacattctaaatgcacattattatttgtgcatcgaacattatttaaagggttggttttctggcttcaagaaagcttttactgaatacaataacaagatattgcggagagctttcaaaggagggccctttgagcatcttgaattgctttataaatcggttctgtgccttaatcgttgagaaccaaaattaacttttggtttgaatgtgcaccaataagtgctactcacacttttaaatcaaattccatgctttgattagaatcattctaaaagtttctttttgtcatgttagtttactgattgactttctaattaattgcacaccattaaaagttgcttcactgtgatagtgatttcgtacaaaatcccaaattctttgctagtaggcctaactaccatggtccatggcatactaatcttttagagtattaaaaagttttccccaattattatttaattttttttaaataatgatatttgttttaccgtgtgtttggatgagcgatagaaaacgcatgtcaatttcaacacaaataataattagttctacgttattaatacaattaatttaaacataaatttacctgcaaatgtgaatttgagatgctaaattaaacacacacttggtcatttgtgttcatgctaaaagaaaagaagatagcaaacgtattgggaaacagaaagaagtataactcctaaaatgtgttggctaggtacatttcaattccaagtaacaatcatttgcaattataaaataactgtagtattttcgtctacttgcaattatttttttgcttgaaaatgtttatgtgcttattgatatgattaacttttgtgtctaaaaattatcttattaattttagttctcgtaattttttttataaaaaaatagcccatgtcagtacaaagtggtgatgtagtatacgtatacatctagctgtattatataactaattattctgggggtgctatgaaaacatgatatgtctaaatgtattttacatcattagtaaataatgatggcaattgatttaaaaataaaataaaatttatgaaggttaaaattagcaatatttctaagaactaaattaaattaaattatatttatagagactataagtatattttatccatttatttttatgttgaaataaatgataaaacaatttaaaaaacttcaactttagatttataactgcgccatgcagttcaaaaattaactgcagggatccggttccagtcgttccttcttacaaacaatgtaatactggtcttggagccgagctggtgcatattttattaacttttccaattcagtgaaagtaggttatatacctaaaatgataaaaacattcacaaggatttttatattttttttagttattttgatgtagatttcaacccaaaacttttaagatttttaaggaaataattattgatcctgttaaaatttaccataaaaacaaaactataacgcactgaaattttttctaattcaataacaataatatcatatatttttactctacctatatatagtttttttagagttacctatatgtagttacatccatgccccacgggtaaggagatgctaaatgagccattcacaagtaccgatagtccttatgggagaaaaagaaggcacttactatttacacctccttttactaagtacacccacatatcccctttctacctctcaattattcattataccctttttcttaaagaagtatatcacttttactttctagaaatttatttctagaattatatatagttattccaaaaatatatctctagaactatgattcataatttcatagatatacttctgtaataagtacatattttttaataaaatattacttaagaattaagatgatttacgagaaataaaaaaatgataaacgcttatcttatactcgtatttcttagtctaattttcatcctatcattagtgttctttaaatcctatctaaaatcttattttcatcttatctttatttttctttaaatctaattttaaactatcttctccatatattcattgtataatattgtgttttcatcattattatacaatattttgctttttccatcatgtgacaatgggtttcaaggtacgttcatcattaactctgtgtggcattgaatcattaacgtagacttgaattaaataaaacatgaatgaatatacttaaggaaaaaaaaccatcctcaaaagctttgttttgtaaataaagtgtatattgtatgaatttaataatgaatgtaccttgaaacatagttttagatgaaggaaaccacaaaatatgatataaagatgatgaaaacataatattatataatgaatatatgataaataatttaaaattaggatttaaagaataataaagatacgatgaaaataatatttaaggaacattaataataggatgaaaataagactaacaaacatgagtataaactcattaatcatcttaattcttaagtggtattttattaaaaaaaaatatctattctgcaaatatatctttgaaattatgaatcatagttctagaaatacatttctgaaataagtatatgtaattcttgaaagacatttctaaaaattaaaaggggtgtacttctttaagaaaaaggtataatggataatcgacatgtagaaaggggagaacggggtctaaatagaaagatccaaaaaaaatgttcggcctaaagttataagagttaggtgtatgggtttagcccaacaagtgatcatatcgggcttgttttatttcttcctcttagtttgattacagaaaaaacaaataaaaaagaaacataacatttggtagtaggggaatagaaatgagaagagaagtttaaaattttaaatatttggagcggagcagagaagagggaataaaaaaccatcattctaataatattaagaaatctgaagggatggaaaaatatgtaaagattttagactatagtgattaaattatggtagaatataagctaatatagtctttttcaatatagtactaggtagaattgtttttaaataccttattaacaagttaatagatcagtttaagaaggaggcgtttggtagtggaaattaagttttaacaatactttgtaaaatatattagttaatcctaaatgcttaataacaatttctattacctttgagcataactctttttagttttgttgatgctaatcttatagatctaatttaaaattaaaatttagagatttacatattaatttaacctgcagtgaaaaaagattaatttaacctattaaatactatataagaaaaaaatatttatttatatatctttataaaatttaaattaatagcattaagtattacattaatatttcttgaaaattatagtgttttttttcttcaaatctagtttacttaaatagatagatatacttctctaatttggtttaccgccaaaataaatttggcatcaatttgattttccacatgacaaaatgaaagcaaattttagtcccctaaaaaataaatcttgagactttccattgattagattataaaaacgagaaatgctaagaaaacattcattattgtttaataaatttaagtaattaatttatattaaatataacttatatttatcctctatctaattaagatttgcataacattcatctaacaatataattgagtacaattttttaaatttattaagtggttttttaaacagaattaattaagtgatttgatatgaatatatcaaaatgatatatcccctttgtcaaaatgaatgctttcaatacagctaattactgtatttttcaattctgatttgtcatcgaataatgcacgactattttattttttgtttttggttcctttgattttgttccttattttatttttaaactttgctattaattcttgagaaaatttcttattgcaaactatggaaaaatgttcccataatagtcgtatatatatatatataaatataaagccagaataactaaattattgcaagtagattgcaaattgcaattttggtagggcactgaggaccaaaagtctaagagaggggatgttgttaggttgtggcttataacttacaacgtatttaggaaggactaaaatgataccagttgtgatccactacgaaatggaataaggaaataacacaattaacaaattatggggaagtctatatcatgacgtcttatcttgctatgcatggggtgtgggaacaatttgacagtatgtgaagttttttcccactaaatttcgtgtttctctctttctttttcaatcggtaactttttgagcttgtagtgtttcgtgtttgtgtgtgtgtgtgtgtgtgtgtgtgtgtgtgagagagagagagagagagagagaaagagagagagagagagagagaggctattaccaatatggctccatgtagggaaaagaaacaggcaaattagcagtcaaaggttatgatttctggtgttaccctcattgcacatatataccacatgctgcggaattgaatccaagacttccaacgtaaactttttgcataatcattcaaattaacaaagtgcaatgaatttccaacaactcgttgtcttgctcactttccttaaatttaactacaaaaagtttattgtggagaaagcttccttatcaaagttaggacatgaaaactttctaagtggaattacgtactagtagttgagaatggaatttaagttttttttaaaacaaaatagttaatttcttattagctaaactacttccattaaacatttgattagtttttagttctcgactgaaaatgtccgagttaaaaagaaattacttccatttattagctattcacatatttaaacataagaagtcagtcaaaaaaaggcagcaagaaagcacaacattttttgttttctttttaactcaccgaagttttaaattatttgataatatttaattaaattagataggttaattaggagaaatttaacaggactagttattttcacagttttatgttgaaaatacgtcgttaaaataagaaagatctaacctttcaaaaaaagtatacaaaatacggggcaatcactcactttcattagtggggtttaatggtggtattttgtcgcatgatatatatatatatatatatatatatatatatatatatatatatatatattataaagtatattttagaatgttaaactaaaaccaagattttttgttatcttggtaactcaatatttccatgatttgacctgaacggattccaataggagatgaattgtttttgttccacataaaatatagaaagacgtgattatatatatgtccacgtacaatgcatgagtcactccattactactactagcttgtacaatttggctttaaacccttgagagacaaggcaatttatgttgtctgaaagccgagggtagcatcaattgaagagcggggagagtgataatgaagatggtggcaagtgggtcctccaatagcattagtgtcatcagtggagcaagctatgcactagatagagaatagagatatatggaagctgcattgtgaagcaaagcaaacccaacaccaaaagaaaagtggcatccaaacaaacatgtacatcataatactcttctctgttcatttccatgcttcatccttcatccttcatttttcacctactaccacaaggtccttaaaccccacttccattccataaagcaagccacttcattgaactccaagtttctctctatctttatccatgcttgttcctgaattcatggattgatttgacaaatgtcttcaactacaagatactcaccccaacatacatagagagccaggttatttaactttttgttgccattcattctaccaggtgagaaaaccctcttcttttgctgtttaatcctttagatacttttttttcctaatttccactgatttctagcttgttttataatcaagtttttttgttttggtcttttatgtatccaaaaggtgatcattgatgatccaaatatcaacaccaactctttttctctcgtgtttcctaattttggaaaccttctggctggttgcaaagcaaaattccaaggcataacaaaggttggaacttggaatggattcattcaatcagagtgttcagaattccagcttcaggtacaatccaaattttaacacaaggacacatgcagatgaagaagctgagttctcagggattcttgatatctttgtccatcatgccaggaatattcataacatatgcatctatgacaaccaggatgtgtatgctaagttctctctcacttacaaccctgatgagactctctctacaagaatcatcaatggaggtggcaaaaacccaacattcaatgaaaacttgaggatgaagatcacccaaatagatgctgttctgaaatgtgaagtttggatgtttagtaggtcaaggattcacatggaagaccagcttttggggtttgctttggtcccaatttcacaagttgctggaaaaggaaaggtgactgaagattacagcctttcctccactgatcttttccactctcctgcaggaactgtccaactaacactgtctttggacccctctttggcaatctactcatcagtgaatttgataactgaatcagcaaagaactcatcaatatcatcagaagttattttgcttgatagaaagacctcaaaagttatgttggacccagttgagtatgctagaattgagtttcctgacatcagtgtggtgaaggagaatcagcaaatggtatctgagtacttcaatttggcttctcaaggtactacttctgctccttcaaggtccaacattggagggtcactaccatttcttcaccttggtgcatctcctcaacttgatgattatgagatgactatgagttcacaagatgagaatcatatagggtccatttctccaaatgagagcattcagaactcttgcttcctaggctccaccatcacaaccttgagtgatgatagaaactcagctgattcagttgagaaaaagaaccatttgagcactggtgactcatcaaattctgtaactgtgtcaatcactgtggaaggtagtcaaaactgtggggctggtccagataccccaacttccaagaaagaagaaggtgatgccagaaatgacaaagaagcaaacttttcaagcaaggaaaaggaaagcaaaaaaaccaataacaacaacacagaagctgcaaagtttggtcaagttttttcagctccactagggaacatcaatttagaagctgagcaagctgctatgcaaaaacaaatagtggacatgtatatgaggagcatgcagcagttcactgagtccttggcaaaaatgaagcttccaatggaccttgacaaacctgaaaaagtggatcatggtgatggtgatgtgattcagaatcatgacagcagcaaattagaaattgataagaaaaaggatggatcacgtgtgttttatggtagtagggcattcttctgatcacccctcttggtgctgaaaatagcaagcatatgagattgtgagaatttaattattatagcatcaggtacctacctcaatttcctcagtgatatttattaaagattttagttagtcctggtttgtttgacctgcactttaggtgatgacaataatcttctgttttagatgtcttgtttattgcttaactcatggctgtgcaacccaaaaaatgcttcatgagtatgcatcagttttctatagtgtaatcatggcaatgtttttgtcaattactataccattaaaatcagtgacttttaaagcatgtttatgtactaaaaaatggcaactcttgtaaagaggattagatatatgcagagtaaaagctattcttttagaacctaatgtgactcaattaacaatgttgagccggtagaagaggatatgggttttattcttacatttataaattctatgttttagttttcatatgaacaattattttatgttttaattcttatatttctactctgtggcagttttatattgctagaaaattgagaactactaaaacataaaaaaaattgcatgaataaatagactaaaacagagaatttttagatataaaatctaaataaaaagatgagacaaagtgtaaggatcaaatgattaattaaaaaatttgtttatgagattaatccattttgtgcaatttctgatagcagtagttatattacttctgcggctaattaaattgcaagaaggcacagtgttaatacttcagaggactgagtgtttaaactatattcaccattctacttcaatatgcgatatacgttttccattaaaaactaatgtcatgatcaaaggctaagaaatccgagccaaattttgttgactattgttattctggtgtggtggatggtggggcagattcaccaattttgtcaacacaatatggagctcatcgtgaaaacagttcagaggagacaacgaaatctagtatgtggaatccaaaaatccacgttcacattgttctcgttattgctttttgcacaatcaaaattgcaaaaaatctgtcacaattgtcaacgttactgcatctgaatttaagtggaaaataattagtgaggtttaggtaagaaacaataatcaaacgtaggcacatcatcaatcatacataatttgttttcagctaaagaaattgtacatttttttgttgttgttgttgttgagatgatggttactgtagtagtgttgcttaaggaagaaaaagcatattcatgtttttatgtgcaaaggacgaaaatacgacacgcgtcaattttgttagatcaagcaaacaaagcctattattggcttcggaactggtccatacgaagttgttgatattgactatgaattggttgctttattattacattttgtcctcttaattaggaccatttttcagaagtttgctttgtaatataggaaagcctattggctattgtgattatcaagtgaagacttaaaggttatgtttctgacaagtgatgggaatgggatgggacaatgttcgcccaattatgcttgccttggataagaaatttctcatattttgatatttattatttgaatattaaataattaataccgtatttgatattatatacattttatgttattttattttataaattagatgtgtttactagatttggttaactcaattaaaattaggagcctaaaagtacttttgctctaaaaataattttttttttaattagcagagttataggtggtttgataattgagaaagtacataaaaattagagttataaataaatcatatgtttaaatatttttactataacttattaattattaatatctgtcaataaaaaataaatctttctcaattcatacattagaacacaattttatattaaaatttgaaaaagtatttttgtaattttaaaccaaacattgactacttaataaattgctttgtttttcacacacaaattcgtattttttaaaattaaaaagattttatcttccttcagtaagaaaaaggtgatcttccatgatgtattgtacagaaatttttatctttttatattatccattaatactaataccaaagtcacatgtaaatggttgtaaaaaaaagtcacatgtaaacatgtggtgattggaggtgggtaaacgggttataatatgcgaaccgtccattttaactcatagctcatgagggcttgagctcgataagaaccaacccatttaactcaactcatatacaagttggctcatttagcctgcagtttaattaacaagtttggttcgtaggtttgcatactaacatgtttataattcacataacaaataaaataatgattcatttattaaagaattgcaaaatttatgggtctgtttgttacagtatttttcgtcaaagaatcacttcttcttcttcttatatatatatatatatatatatatatatatatatatatatatatatatatatatatcagttttaaaagttttttttaattagttgcttctttaataaaaatgttttctatgattgtaaacaaacataaattagattttgctactttaaaatctctaaaagaaagaaagaaagaaagaatcatcagtttattttacatcaaagttacttttttttatataaaaaaattgtaacaaacctgcccgatatttgataaaatataatagagataaaatttcttaaaaaaataagattattattgattttataattttttttaaaattaagaaataaaaactaattatatagtaaaaatataataaaacataatattcactttaaaatcagatttctttactatataaaaaaaatagggaagtcccgtcagtcctataataaaaaaaatcaaaaaagtgtgtgagtgagttaaaagtgttgaataatacaataatagagtttttgtatatgtttttttatctatgtattttcgtgtctttaagcaaggagaaattatacaaacatattttctctgagatttaatcgtataaaaaaaattgcatgaagtttgtagagttttaactaagtgggcctgtgtgcccatggtgggtttcactttgctgaaagacttcttcaactggtttattttgttgttatgatgagcatagtttctagtgcatgtgtttgtgagtcttgttctcaaatcaaattccgtgctacaattttgttctctttgcttctttgaccgaaaagttccagtaatacattaaaataatcttttaaatcacgagtattaattaatttaagtcttgaagttttaaaaatatttttttatgtccaaagttactaaatgagcaatatttttagtagctaacgttacaaaataatagttgttttaaatgatcaagaaaatttattacagactgatagatataatatttaagaaaatttattacagactgatagatataatatttttaatataatgcatgtgattgaaagcttaaaattggaaaataaaataccctctatcgccccaaccccgtcaccgtgaaccacctttaacgtttaacatactaagcagaaaaacatggcaccaagcctcagttaattattacaaattgttatatataatatttttaattaaatgtcgtcatttgatggaaaaagacccacaattgtgttaaaaaaatcagagacaaaagaaaactatgaagcatggaacacttaataaagaaaatgtaattaatggcaaatgactaaatataaaatacatgaatttttcagcgatcaaaattcacttttattagaggccaaatacaaaattcataaatttttcatggaacaaaaatatatttaaacaatatatatatatatatatatatatatattagtgaatttgtcccctaaaaaatcttaaacaacactatattaattgttcaaaaaaattgctacaaaaacaatcctttaatgatttaattattcaagaaattagtttcataaaattgtgagatacttttagaaaaaaaaattaaaaatagataaatgtgcatctaaatgaaattctaataagtggatccccacatcatccaatctttgaaactgctctataaattgtcataaaagatacaaaaggttcacaccacgtcctgcatattgtgcccccaatctctgaattgctttcttcctctttgtgaaactaccctccctttccccaccaccatcatcacctctatcatcaactttgttgtcacctatctatgttatccactgagtcatatgttcctccccatgaaccctaaagggatttaacaccaaaaagcctttcacctttacctcccaagaacattcccttctccttcttaaacattcaactctcgaagggaacaacacctcaacactttgctggccttattagaggcaagtttattgctgcggaagaacttgtgtataaatctatttagatactaggctagaagtacttttgagagtttctcttctgaaaaaaatactatatttttagtagaaaaactttcaaaaacacttttgacttgtatccaaacagatcctatgttatggcttcaccgagcatgagtaccaagaggtggggtatcccatcacaaatccaaatgttcaacctattataaatagtactcatgctaaccgttatgcttctattatgagtaatgctatcaattatggcatcaccaacaacactgttggagcttcaacctcgtctcaaatgaatgcccaaccccctacttctcctacagatttgaacatgctcaattggaacaaccccaccaatcaaggtgacaattgataaggagggatcagaaagcttcatttgcgactttatgtgatttgaataatacaataacaaacttatcgtttatgcttttacctatgtatccgtgtgccttcacgcaaggggtaataattatacatattttctataggattcaatcttgtagttcctaatttttttacatgaagttttttagagttcttaatcggcggagttttggtggcaatgctgggtgtctctttgctaaaggctttctctagctagtttattttgccattatgttgtgtacagtttccagtgtcgatgtgtttgtcaatcttgttctcgaatcacatttcatgttagagcttgttgtcgttatttctgctctgtttgaaaagttccagtgataaattaaattaatctcttaaatgacgagtattaattaacctaagtcttaaaatcgaagaaatattatttttatgtcaaaagctactaaatgctcattattattttagtagctaacgttaaaaataataattgttttaatacttgaaattacaaaaaagaatgttttaattaataattaacgttaaggtaatgacaaaagatttttcttcttcaaaatggagtgttgatgcataacaatgaggatatacatctcaacaatgttgacacctacatccttgttgcaaaagaattaataaagaatattttgattgaaaacaacgatcaaaatattttaacaatattatattatattttataaaaaaataataatattacgaatactaattaattattcaaaaaataaagatttgagtgactaagttggatcaagactttttcaactcccaagttgcatttgcctctttgtttttgttttagaattaggataaagttatccataaacacttataagaaaagaaaataagaaagaaaaataacataatgatatgtttgagtaagggaacagtggccaaactgccacggcttgaaataaaataacccaaaaggcacgcagcgaaaaaaatttcccccaatgccacgcggcatagttcgcaggtactataagcggatttagtggctgatgtggcgcgtcgcaattggctgtggaggagggcgctgacacggtcaaagctcgctagtgtttattgcgaatttagtggaattcgctggtccaccctgcggactatgtggaggtcgctgtacctggccgcgaattgtgtgtggacacgcgcgtttacctactttgcatggggctccagcgagttatgctgctggtcactttcattgtcccccacaccctcagcttgcttcctctgcagacatccaggtacttttttttttttgtttttctgtttgtattttttataatttggttatttatattttaattaggtaatttataattagattagatgatattaaatattagttcatacttatttagttagaggttatatgatgaatttatagaaatattagattaattttttgttatgttaaagtacttataataacattaagcaaattacttatatattaaagttgataaatataattagctttgtactccatgatattcatggttagttattttgttttacttttgtgtttttattttttgtaatttagtcatttatattttaatttgtgaatatatttagtatttatgtagttttagtttgttaaatactatttatgttggagatttaaaacattaggttagagtatatttaatgttagtttataattatttagttagaggttatatgatgaacttatagaaaaattagactgaatttttgttatgttaaagtacttaatttaatttatttaagtaaaattaatatatagtaacattaagcaaattaattatatattaaagttgataaatataattagctttgcactccgtgatgttcatgattagttattttgttttgtttttgtgtttttattttttgtaatttagtcatttgtattttaatttgtgaatatatttagtatttatgtagttttagtttgttaaatactatttatgttggagatttaaaacattaggttagaggatatttaatgttagtttattatagttgataaatataataaataacattaatcaaattatttatatattatagttaataaatatatgaaattagatatatttaattaaaaatgacaatgttattacattaggatattaatttgtttgttaattaacgtatataattttttagacagattacacatttgttaattaacgtatattacatttgttgtctagcagtcaatcgagagacagattatccgcgttgtaatttcaacttcttgtaaataattttcatcagatcacgatggttacatcctgggagcatgtgaaacattttactttctccttcaaatatttgaccattaggtccaaaatatctactcccattataatacacaatggtaattagatcatttctactactactcattttgtggtaaaaaaagtcaaaaataacagaacaacgcctttgggacaaaaaattaataaaccaatttaattgaagatctcaactaatttaaaaaggggtgtaaatagcaataaattccctgtttcatgcagtaaaatatgtcacctaatttactgtgccaaagtgtttgaggctgaaaaatgacaaagcaaaataacacaaaaaaattaataaaccaaaataattaaagatctctactaatttaaaaaaaggggtgtaaatagtaatacatttcttgtttcatgcagtaaaatatgtcacctaattcactgtgccaaagtgtttgaggctgaaaaatgacaaagcaaaataacacaaaatatattgggtgatttaaaaatcggacataaatactattcacttctgtatagcgtgtgagattttgcggtttttttggacacaaggtgtggaatggggtttataaatagtaataaattcggtgaaggggattgagtgatttaaaaatcagacatacaagtatagcgtgtgagattctgcggtttttttcgacaaagggtgtgaaatggggggtatatataggaataaattcgctgaaggggatggcaaaatatgtcaaataattcgcagtgtcccccagcgaattaatagggacctaccacgaggcagaagggctcagaaagccatgtaatccgctaccaggtaaaacgaatttgccacgtaatacgcagccatgcaaagcgaatttgtcagagagtacttcgctcctctctatagcgacttctgtttgccaattaaatgacgccaactcagcaaataaacttcgctggtattgccaacgaagtatgttccgtggcattatggcaaaattccttggaggcgtggcagtttgggttttttatttgccaagtgtggcattttgggcaaagttcctttgagtaagtttatctataagcatatttaggagaaaatataagttaaaattagcttaaagacaaaaattaatttgtaaaaactctctcatataagttttctaaaagatgagtaattagaacatgcataagttaatttgacgttatatagaaatttatttcatttttttcctacaattgctttaggataagcttatccaaatatgtctaagtttcttcataaactaaatgatcttatgcataagttgagaatcaacttttggagaagttaatatgaaagaatttatatataaattagtttatgcataagttaattttagcttctaaggaagtttttttttcttattatctttttgtatgtatttataaagaaaaagtgtcccaaaaagaaaatgtggtttaacgatcgaggaatcagtctctaacatttacaaaactacagactaactatggaattagagaccgaaaaaatatgtcccaaaaaccaaatcaataactttaaacagttgctaatttaaattactcattcgtctgctgtttggtcacttttcttggcaaagggctaatatctctaatttagtcactgattttttttaataaaaaaagtggctatcgctgtgactcctgtctctaattcaatcacttaattttgtttcatatttttttgaagtgattgtagaatacactttagttgctacatcagtggctatatagccactgaaattctttggttgctgaagtaaataaataattataataattgatttttaaataaaacaaaagtaattgtcatttcgatcaataaattgtgacatataactttatgaggttaagagtaatgtcctttttaatttagtgacctcaaattacaatatgatgcctggtttttgcttatttttttgtaattaataaatatttagcttgcttagtaattatgaacaataaataaaattttaaatcacattcaaacccacaataagatatataatatattcataaaaaaatgtataataaagtctagtttcaatacttgtaaacaacaccaaacacaatgtatgataaaagtgcatattcatatcccacattcttataatcttatttattatttgtaatatatgtgaaatgtttttttaatacttttaggtttattttttaccaaaaaatatcataaatctttaaattcttttataaaaaaaaactatgttgtaagacatttttatttttatgttaggtctttttaaaaaaataaaagtttaaaaaattatttcaatattattttgttatttttatttatattgtaattatatatgaaatattcacaacattattaatatcaataattaacaacacatttcagatccaaacctctgactttcacacatggattagaaaaatataagtccttttaaaacattttactacggatatgagtgagaatccttatataaagacttaagattcacatatattattttttttaataaaatagtgtatttaaaagatctgcattacgagtatttaaaaaagagaaagaaaaaccataaacctgcggagatgaggatgaaaatgtaagacctatttggaaaaaaaaaaaaatcttgatagaaacttcaaatagaaacaggcagggtcagcaaatcacaacaaaacctcacattctaagctctaacaaaaaggaagtttctcaaacacagaagaagaagaagaaaaccatgttacaatgccttgagcttctctctgctgtcatcttaacatttttatttcaaacaaaaagaaaagaaagaaaaaaagaaaaacagaaaatgacagacataaaatgcagcagcaggaggcaggagcagactcatgatgcatacggtggttcaagccgatttggttgccggcggcgccttgctcttcgccggagaagtggcggtgagaggagagtctttgatctcttggtgggtctgaatgcgtgaggcttgggcagcggcggcggttccggtttcttcggtgatgatttgtgtgaagtcaaagggcttagtgaggtcttcggcggcgaagaggtccggcggaagggcttgggagggttggcgtcgatgaccggacatggttacttctagttcgtactaccaatgagtctaagagggaaggagagagtgagtgtgacaataaatgttaatgtgattgggattttatggagatgacaaacaaactgtggttatttggttatttggttcttactttgattctcgtatgtaaaaaaatattagattaacaactgtcattattaatttataattaagtgggtttgaaaatgttcatatctctcttactcgtcataaacttaatttagggtgtaccagtacaaagctacaagggataaaaatacaaaagaaagctagtttacaagaaagacaacttgccaagtgccaatgtctacggactacgggttcatgatttgattttcatgttaccttctacaaaagaacttagaattttgtgaaatattgaagttgcactttattttatgggggtatgtataaaaggtaaagaaaattagagaaaaataataataaaagagagataaattgagtaagaatggtaaaggtataagtattcatactcacatatatacgagataaatgagaagttgaaagagaagaataaccccgtgtcagtattatttttctattcttttatccttattcatttcttttatcccatatgtatgtggatatggattttttttgtataaaagaaatgtcaggttaattattatattccaaaactcaacttctcttccattgacatgctagatcgagaagttaagtattttttttagagaagatatcgagagaagttaagtatttgaataaaacaacttgtcatttttattttacaaatcatataatttttgtgaaaggcaatcctattttgaataacaatgacaaaaatattcatatctgaactattaacttctcttctcactctcacttttttctctggtcctttaaactttgaaaaatatttctagaagtttaaaattctaaaaacacttatataatttacctaactagtcgtaatattcctgaaaatattgtttatgagaatgcaaactctccccatctcaatttccttcgcaaaatgttttaatagctagaactattattaagaattgaacccatttttgtcaatcgcgtacgattgttcaatcctaccaattaagtcatcccttactggcaaggttagacaaaatttaatttgaaaatgctaaattattctaattaacttggtgaaaccctacatgttggtaatatggaagaaacccatcgtgcaatgacggagtggatcgcgatggagagcgatggaacaacgatagaaatgtatttatatagacacaacgcccaaataattaagcttcagtaaatgtaattgagtaatcaatcaagagtacttataggaatgtttggaataaggtatatgcaactaggggtacattccgttctatcaatatcggatttggcgatttttgacagttcaaattttagaaattacatccgatgtaatttgagggtgaattgggttgtccctgtcaaattcaatgtattatattctttaaagagtatatataatttttttgaataattatttatagcagataaaaggtactgtagtattttacataatataatactatatttataatcattttatttattttcaaatatatattaagccttagtttaagttttatatatatatttttttattgtattatttagttttacatggtgctaaatcaagtgattgaatgtaaatgattaatgtgttgaagttaatattaaatttttaaggtaatatctaagtttgattattaacgaaaactttattgatcttttaatcaaattcttaaatagttagagtctttttttctcaataaattagagtattaagataataaaaaatctttacacaatgttaaaattgatatactagaatcattaattaggatagaacaattggtgagaggtaatttgcataagatcttctattctaatttgttttcgccaactatatatgtttataaatttaatttaattacctaataatgtgttatatattatcaagagttttgaacaaattcaaataaatgatcctatcataattttagttgaagaagaaaaaaatactcatcaccttgcatcatatgaattcatgatcacccttagatgcaagcagtggtattggtcatggtcagaggttagggcaaacgtgggccacaagctacctggtcatgctattagtatgaatagtcctaaaaacatgatgcagctggtacgaggaggatgtggagcacaagtgaataagtcccaaacatcggggtcatgcaaaatctaacttgcaggtaagtaaggttgtcaacccaccctaattctgcatgttggagaatagaaggcatatggttgaattaccaaactttctatatatatacacgaaccgtacgtgttgatagtttgtaagtagaattaacatatgtgtaggaaacatctgatttagttcaaaattcaaatgatcaaaaggagtaatatgctgtatattattttataaatgttcatgttcatagaagactttttaattaatttttatatctagataatttcaataatacgcatgttaaattatcattaatatttaaaaataatatattataaaaaattgcataattaagattttaattttactatatattgcttcttgtatagacattgcctaaagtggttgtgtccactaccactgttaatatagttttttttagtgcttctcacggaacattctattcagatcgatataatgagatagataaataaataattaaatattaattcaataaactcttattgtataagggttgatgtcataaaacttgttaaaactagtttaaaagataactcattactcatgagagtcgcatcttctttcataagatcaaataaatttctcgtagatgtccttaataattgataaacacgtaggagttgtctattatagagatgtactgctatatagttaacaggtttaaaacacgtaggggcatttagattgttaatttaacgttttgaattcaagtaaattgttaaagttgttcactgttatcaacatttatcaaacaatttaactcaattgattaaatagaatgtgttaattattattaatcatttattatcgataaaaaaaaataatcatgaacatttgggggatttcgatgaatccatcaagcaaatggatggcatccgaaaggttgcatggagattttctccagggttaagttgaaaaaaatagtgcaaaaaatgagagattgaagaaaaggaagatgtagtatatgtttgttttttagttgcaaacagatgtttggtgcaaaatgaagtttgtaaaagctccagactcttcttttaataaaattaagtttgcaaaccattagatttattttgggatttgtatactgcattttgaactaaaatccaaacatgcacttagaagataaattttaaagtactgaaatcaaggtaggaatgtaggatgtagggacattgatggcgtgtcctgtattctcttaatcaaaaggcattgatgagtagtttgttttgcattattcttaagagtgataatggtcgcatattttgtacttccggacttaaatataagcaaaaaaatcactttataggttgaactcaaaataagcaaatcgaactaaattcattctaattgattatattttttttgtaaaatatcatttatttaattgcaattcaattttcaaagattattttttattcataatatcaagttccaataaaggcattgtaccaataatcttattttttatttgagattagtataattaaatgatgtcaattaactttcttaattggtaattaattttgcttatatatgaatccgaatataataatcctttaagactcttaattttggtgttgtgaatagcaaagttaggacttcaattttcaagttaatacaagtttgagtctagggatgaaaaaataaacatcttgtgtaagttgttttagagtatttttaattatagagcaaagaaactaattatcttatcattacagtagataagttagttatagataattaatgatcatgagttccaagtcctttgttaattcatgtaattttgtgagggccagagatacttgattataggaaaattctttgtacccttggaagagttatgtttttcatttgctctcttctcttctatttttttttcctttttatttgtccctcttttatctactcggacactccaaatttatttatttaatcaaaatcaggagatgtactagagcatattaaagaatgtaattccaactagattgacattacgatcatcaataaccaaaacaacacacttctctgtattatattccaaaaagaaaataaagaattgtgggaaaccaaaatcaaaattcatgtataatcatttgaacctataacaaagacatattatatttatttctaaataattctttctggataaaataagaaagagagtctcaccaaaccaaatcattaatgataatatcatgtgaaaatatgagatataaaaaaatatggaatgaataagatttatgtaatttattcatctattaattttcaagtcttcaaaatatcacttttaccgacttaaaagtttgaatagtaagtatcaagtcacactcaatccaaaactttctctaccctctagctaaagctatctttataactatcatgaccccaacatgcaaattcaacataaatagcaagagaaccaagttaaaagggaaattaattaaaccacccacaactaccatatatattcagcattttccatttaaaaatgctcaaaaggctcgcctatggagctcctagattttgatatacaatcataaaggagtggtgagcacattcaagcattatatatgcctagcgtttgtattttgtttggaaacttcaacaaataataatttaaataaggacatactccttctaacttatttctttgtaacatttgctcaaataatggaaatatatatagacactagcaatttgcaaaatgggagattattgtgaaatatggcagttatccaaacccagtgcacatgcaagaacacgttgtgtatactgagaaaccaccggtcatcatggtgttggggaaagaaggtgcaaaaacatctattgcccaaaaataaaatctatccatgtttaacaggtcgtggtgtgcttctccattatttttacgtgtacaattagggcaagacacacgcgcgtggtgtgggatgtgtgcgaagaggaaaattcattagagactgaaatgatggaacgcgtggcgacagaagagcctcatgttaacaaatttattatctctgtgggtctgaatgagttagggcttagggcacatatagttcaactaaccaaatctaaaaggagaaatttcactgcttgacatgcttaggacttagataccgttttatatcaacattatatttgccaaaaaaataataataataatatcagcattttgttgatttcattgatactaaactcacatttagtatttttaaattaaattgtgaatttaaaactttgcaaatataattaaaatataattcaaagagagaatctattaaaataataaatatttttcaacaaatattaattaattactgagaaaatgggtgaatatttcacacttataagttataatataataacaaaaaataataatttcttatgtcttcaaaatagtagtaattgataatgtcagataaattaattagtaattaaaagcatagttaacaaaaaaaaatacatataattatctcgtcaaattttttagtaaggtgacatttcaagacatttcaattatatgtcaatattattgttacgttatcacattgttatctgataataacaaggattaaaatttttaaaaaattgtatggattaataggaaaaaaaaaacttcataaactaaaataaaaaatgctctatttgatgaggataaaaacttagttaaatctgaaaaacgttattgacaaaattcaaagtccaaatgtggtcgatactcttcaatcttgctcggccagttgatttgcgagaccatattatatatagaattatgaaaatctgtattttaacattctaagcaatgttatatatacttcccttcaaataccaaaaattcacattatttaatttaatttaattgatttaaaaagatgtaattaaatattttaattaaattgtaaaaaaattatattataatttaatcttagattattgtaaatgataatattttttaattttgtaacaataattaattactttaaaatttataattataattataattataatgttcttaataatttagcagcagtgcaaaaatatctgaaaaaatatatatgaaaaggaaactcttgaaaagatatgtagtaccagtctgacaccctgcatatatatagaaatacaatgaatcttgtgcataaggatataaaaattagatatacaaaattgagttttgtattaattgagcaaaaaatgttctacatacatataactaaacaaaaataaatgtagtagaaatttaactaaactctttataaaattaattaataattaactcaaattccaaaattgaatattcgtattattaattaataatatcctactattatataattataaaaaatctcatatagtattattcaaaagaagacaaacaggagcagatatccagacgcagacccaatgtagtatcacgttacgaagataatccctcagtcttgggagaatccataactgcaacgtcaataattgatgtacgatgctgaaacaattaaggtattattttattactgtattaattggttcgtgacaattgccaaaaataaatgaggggacacgtactgcaactgaacactgatctgtggacactgcttttgtctgcatgcgcatatattcttctaccaaaacattagagtgccaaaattattcttcaacattatccgtagaaccaaagtaaaataaaacacaatatgtaaatgtaatattttactgcattatattatccacgtacgtaccattctgcatttcgctccttcatatgtccccaactcttaaaaaaaagaaaaggtttttactaagaaaaaaaattcaaatttctcaatttatggcttttataaattaataaggtatcttaaaattgataacgagtgtttaaataatatctaccgagaggatttacatagaatttattggattattttggataaaatatgtaggaataaagaagaggaggttttttcaccaaatcagaatatctattggtataaaattgttttaatttaataagtgtcttaagtttaaattttaatgaaatatacaattttatcaaatatttgaagaaaaaaattatgttatacatattaatcttacttgactcaaatattattattttctttaaacgatacaagtgatttatactataaaaagaaagatcagaaggaattttgaagggtcatgtgaaaatatcataaagatatttatactataactaattttcaaataattatatatggagtatgagaaccatacataaaaattaaactcacattgtatatgcctttgaatgaaggttaaaaaaaggtcttggtttctagatactctggagttagggagattgaagggaatgtgggagtggttaatagatttagaaggtgtgggtatggaatcttgataatgtggggacgactatatataggccaaattggttggctaccagtctgccacaatattaaaattaaagaggtgggaaatgagcgtatagtaccatccttatggcatgatttatgggttcgtgggaattccttatgtaaatcagtaggttatataaaatagcatctaattcagataccaaaatagcatatttagaagtgtggggataaagaaacatggtaatcgaagtaggattggagaagacttacggtttttatttgagatgattaacattttttatgcaaaagtgaacagtattattaatgttgcagaaggacagcattaagacgaacagagatatggaaaactaattcgatcagtgagtgtttactatatacacaaaatcaagctatttaagtctaatatattctaggtacatatgataaaaattcaagtagttatggctgcatgctaagatgaggattttgcttacccttgtatgttatagcaagtactgaaatctcgtggcttagcttgttaattaaatttatgcagattaatttaaaattaattggtcgtggaactagcactactgcatgacataattgagggcgttaattcaagttgcactagttctattctattttttacgttcttattgaagcaggtttaattttgtgagttatcgatcacttgtacgttattcgatagtatggtgttgtctttctagataatacacactaggattaatttcgtgtggttatattcgctggtttagtatttctgtacgtggaaatcaatttctaatgaggctctcttgagaaggtatatgggcatgtttaggtttctgtttgcagcttcttgatcggacctttgcaaaaggatcttaatttgatatatatactttgggtttaacgtactttcagaggctggccaacagatttctaaacattgattatattggtgaatttgttattgcttactagggctcggatggatcttatggtaccaaggtttatttgattataccttttaattagttgtaattgttggaaatattttgcaagatttgagtacttctagcttgtattcacatttaataaactttgtttatataaaaaaaaggcttacatataataatatgcttgatcatttttaaggcagaccttgtatttaggttaattaattttggttttaaaatctcaaactatacaaattggaggaaggaatggatccaaaaatatattaaattgttgaattgtttttttatactgttatttaacttcttataaataattatttaataaataatgattttcaaaaaatatttattattaattttaaggaaattaaacaaatatccctccttccccgggaaaggaattttacgtagtcattttaatgtttgtgatacaagaaccaatattaaaaaatgcaaagtagattttttataagtaagtaaaaaaaataattaatcaaataaaattttaaccgatgtaaaatagtttccatcgatattcaatccccataaccatctccccaaaatttatcaacaaactcgttcacgtctcttcagttaaacacatccctctatttccctatttttttttcgcattgcgctctcctctcattatatcatcacctaatcccaatccaacaaattttacaaatcccctcttctcttcgtgaggttcccccaatccattcccaatttcacaaatttgaaattttcctttccatcccaaagggaaatcaagttcttacatggatcaacaagacgaagaagcgatttccaaaaccataaatttgctaacaagatcaaagttgttcctaatggcctttctactgattcagatgtggccaaaagatactatgtgttgtgcgaattctaacaatggtgatgtgaatgaggaggattttttatttctagttatttaattaaaaatattatatctaacaaattgtaattaatagaatgtcggtgtcacatattttctcctgtatgttaaacatttctttttctttattcaattccttttggtcaattcaaactccatctaagaattattgtgatgcaataaattttgaccagttaatacaagtttatagtctagtcatcagtgttttttaaacatgacttctaatgtctctttcttataaaaatatatttattaatttcctcctccatctcatttttcaccccctttattctcatgtctttcttctttcagcatcatgtcatttgtcacattttctctcttttttatacctttatcgtttcttccacatattcatctcatctctaagtgtgggttggtcagtgtttttatccccttacatggtcaacactattaaaataaatgaaaaaatattacaccagattaatttatcaaatttcgaaatacaaattaatttaatttcaaaattataattaatgtatatctcgaacttttgggatcgaagcagaagcggaggcaatgagattacagtgtgaaatgtgatttaagagcaaaactaacaaacacattagctatagagattatccacaacttaatgacaaaataaactagttagaaagaatttttaataaagagagtcacatctaggccacctaagctccctcagttaagagttctaaaaatatcattaaaaaaactacaagattaaatctcataagaatcctgtttgtattattacttcttgcctaaaggcacacaaatacataagtaaaaagcatagagaataagtcctttgttttattttgaagactcaaaaagtctttttatttttttatccttccctagtaattatcaccctaattggtcgggttgttccaatatagcatgttcacatttgtaggagtagaatgggtagcaagggattggacattcatcggaaatgaggttgaacctccagcagataaatcattcaaatcattcaaatcaggatgattataactattgttggtgaatctaagacctgagcctagtgagagcaatcaatttttaaaaataaatttaataataatcatcatcatgaataaataaataaatattaaacatataagtgaagtgaaaaaataaaactgagtttaaacatgtaaaaataagagatataaataaaattttaaaataaatacatatagttttattaaaataaggaaatgtattatttattctcaaataaaaataggttagaggtttaaatatacaagataaggagagtaaaatataaaatttcaagataaatctatacaactttatttaaaataaggaggtgcatttgtctgctgttaaataagttaagtgtaggttcgcatctgtcacgtaacgattagcgtaagtactattcatagtaggttgaacatatggattggtggtgatggtttgcaccaccttgtggtactcatggttcttggtgataaaagcgaagacttgtacaggatctgcaacaataagcttggttccaacacttttggttcagttgtttttatgcatttttgtggagcaaattaatcatattgctgctggcacgagtattatcaaagccgggtctgaagtggatatgcagatgggacacaaataggaaggagggatgattgactacacattggtttaaggtgtgacacatgatcagacagacaataattaagcaatataagtattttatctttatcagaattcatttttaaatgtatgctgaagttgttttaacttttaaggcacaatttgtatcagcttttgagttcaattacgaaaaaagaggacgcaaatgtgaatatgtgtgtacagggtatcagagacaaaaagtcatctaacaaaataaaaatatgagtctctggatcataatatggagtttgttcggtttgattggatttttataacaaaatttaaatcagaactaaatcgtaaaaaaatgtgattttttgaatttttatttttatgattttttaatttaagtggatcaataaaaaatctctcaacagcacttctcgcttgtatttaagcagatcatatattaggatttattggtaccaaggcaattccaaaatcagtttattgtttagtgaagatgtggttaaatgttttggtgaacaagtctttttgtgttgtctggtctttttaaacataaggaggatgtttggtgctagcgttttatttagcagtttggtgtttggttttttacccgttacaaggggttttttttttttttttttttttttttatccttgacatgtttgtaattttttctacacatttgaggcacagcttgtgctttgagtatgtattaataatattattcttagggtgcgatgaggagttttagacttttagtagcaactgacatattttttatttttaagttgtcatagactctctttgtttatttgtgtcttggtattttacctataaagaacggttggtttcattggtagaaaataatgcactgcatttgtgacattaggatgtaaatggtgtaatcaataacttggggtttgacatacatgttggtcaatttcaagtttcattaattaataaaattaatttgcttcttaagaaaatgtcatacattttttttataaatatgtttgatttataaatttctatttaaatttatatctacataaaaaattcagtggattactttttaaaaaaaccacaagttatatactcatttgataaattttctagatccatacttattaagcgagaaacattatttgaagagaaaaacaataattttttttgtttttttaaaactattttaaagtataaaatatttcaaacaaaaaatatatatttattattattttaaaattaattaaattatatgatataaataattagttatattatgataataaattataatcataaaattgagatattagatttgatctttaactggtcattaatgtttttaattattttgattttattaagctttattttttttcaaaaaaatttcaaggtattacttaatttgattttatttttttaatttgtggatataattttaaatactgcgatataatttagagaaaaaaataaaaataaaatagtcatcgaaaacgaatagggattcttattttgggttaatagtaagtagatagacattgaatggttgaacctaaaatatgaattttacaaaatttgaagactaaaattgcataagtaaaacttgagagataaaaattatagattaaaaattcagaggcaaaaattacatattaaaaattatataggaacaaaaaaatataatttaacctagaatctgactgacttataacacttatagtgtgtttatgcaactgcattacgtatttggaggtataattttattgcagagagtggtcctatcataattgatatatatggtctctaaaaaaatcattataatttaaacatgaggtaatattacatcaaattacttacattgcattacattcaattttaaaataaatttaaaaatgatatactgtgaaaaaataattaattaaatattaaataattgtttttaaaatttcatttcaattactatcattttattttaataaaatatttaaaaatgtctcttattgttggttctagtccaattgtgtggttttatctcatattatgtcttatttatttttaggtaaataatcatataaatatatgtcgcgcgtactagagcaagtatagaaacaaactaagaggttgtattgaatgtatatttagttgtgcgaatgcacgcgtatctaactaagaggttgtatcaaatgtatattaagtgatgattttttggtaaccataatttgaatagacattctccaaagataggaaaaagtagctacataatttatcataatataagtaattatttaatttttcattttttaaatcttattcgtactggtgtagatgaaaagagtacttaaataatatttattcaaatagatcttacacccttaattaataatatatttgactaaacaaatttgtcttttactttcaactttaattttatgtagttaattttttcttaaggattttttaaagaatttaaaatctaaattttattagttaattattttattaagtataccaaaaatgtagagagaaataaaaatacgtacaaaatataatgtgactactactataacttatttatatactttttatctttcattctttattttatactcttcagtgtaaaagcattaggataatacttattgatcttttgcatgattaactaatattatatttaattgaatatacattatctaaaacttgtcattttcattttttattttcttatacttatttttaaattttgtaaaacaaatagcatttaaaactggtttaattggtagcaaatcaagacaattaaaatttagatgaatgagaattcagtaaaagttacttacctgatgttatcggtattagttactttctcatttacagtaatgtttttaaagtttataataaaaattaattaaagagaaaaatatatgttttgaatgttaataataattattttattttattatataagaataaattaaatagatgggatttttaaaatatggaaaaaaatcatgaatttttttttctgaagggaaataaattatttaaataaagacatacaatcttaattgatatgttattttaaaattgaaaatttaaatgaagattaattaagattacaatagttttaaatttatctttaaaatatcttcaatttgatgtaatacataaagatttattgtttaaattaaaattgaaattacatgatatatttttaataaacttataatgtaactcattaagtaattcatagagtttactgaatgatataaggtcctattgcatgcaacgatagaatagccttcgctgttagtgggccaacaaatttttcctatatagacattaatttttatataaaagtcttatttagtttttggataaaaaaactcttacaatgtgataattcaaaatgttaagtattttttttggtatcggaaatgctaactactttatatagggaacataatttaagatggaaaaaaaaaaaaaaaaagcttgttaattatttattattgtttagaacaattcattaactataacctctttctagcactcttattttgagaatccatactaaagtaatatacgcatcattttcaattgataaaaaaaatacagaccattttcatttaataatatactacgtacatatagtggatttctatattcaattaatatacatttaaacttataatatactacatatagtgtattctcatattgaacaaaaaaaaatgcgtcacacacagctcacaaaaggatcttcaacaaaaaaaagagccacacgcaactcatcaaaggattttttttcttcttaaccattaaccacatattcattcataaaaaaaaaaatattctgattaatctaaaatttaatcaggaaataagtaaattctaatttttttttttaaacatcagactcaaatattattcgaacgatttaattttaactttaataaaaaattatttatgttcaatccttagttacttatcaataaactaatatttaataagattaaaaccaaaatggaaattcattattcaacaaatcaaaacttatatattatttttataattttaatgaaaatcagttgaataagatccttgagctaccaagtagatttgtctttacattcacatgtgagaaataatatatttattataagaattcatttttaattatttttgtgtgtcaaaatctctttgaatcaacaaaaattatatactataagtaacatttatgatcgagtgagtttgatactcttaatatctaatacaaggtgtatccccaaggaaaaaaaaaacatttattttcatatgaaaagtcacttgcaataattaaaaaaaatagagcacaataaattagagttatcaaactttgccatacgaacctaaatgaggaccaaatctgaacatttttttaattgtacgaggacaaaaaatatatttattcactaaaacaaaaggaaaagcaacattgatagaaaaggacatgccctgtggattgcaagtgcatctctttggatttggattttggagtggccttttgcatgaatattcattgtaatggaggctaattagaatgtgtctgaaaccgggatttgcgtccaatgcatccccatgaacagcctttcttaaagctttcttcattttttttcttctttccttttggttttggtgttgtgcactaactgcaccatcatcatatatcatccctttcactctcattttttttttccttttaattttatttccattttggagtcaacagatacaatacacactcagattcatcatctcagtctcttccacctttaaacctccgcgttttctagtgccttccttgctacttacacccgtgactgaaaagtcaacccccccacaaatcccttttccacatccacccctttaccttttttcctccaaagtttcattcttttgcatcttctctcattcaaagtttgagtcttccccatttggggagccctgaattgccgtgcaagttcagatctgtttacgtgagtcttccttcattcatgttcaagcatgcgttttcaccttttatgcgtttcagattctggggttttatgtagtggtttttattgtttgttttttttttttttttttttttttttttttttttattgcattggttgcagttacgtggcacattaactactttatgttatgatgcaggttttttttgtgtgtgaagcaaacggttaaaggattgttgtgtctgttggctattgctatgcactaaagttgtgattttgaaggactaaagtgatgtgagtgggggtttaaaagggttggtttctgggggtttctgagaattcatatttgaataggtgaagattttgaaaatggttgtgagaaaaagcatgggacgggcaaagtcactgcttttgctgctcatggggcttctgttttcctttgccacttataatttggtagctatgatcatggaccataaggcagatgggttggaatcttttcatagaaaaattatgaggtcagaaaagactaattcaaagtttcatgttgccatgacggcaaccgatgctgcttacaatcaatggcaatgccggattatgtactattggtataagaaagtgaaggacatgcctggatcagacatggggaatttcacgcgtattttgcactctggaaggtcagaccagctgatggatgagattcctagttttgtggttgatccacttcctgggggcttggataaggtaaatgtttttctgttaccccctgcagaatttgtatctttttagcccttttaaacttgcgttttttttggtgaagaacatacgtcatggtaacaaataacgatcattcagtgaattcttttagacaacatatttcacaaataagtagcaacaacaaattaaaatttaaaacatattacttcaaccaaacaatcatccccatttcccccaccccaaacataataagagtttatttttctaaagggaggaaatttctcttcacttgatgcaaatgcaatgagatgtgtttaatgggaaatgggattggtttatatgatggttttgtttgaatatcttgcatgtttcttcgactattatggcactggttattttaactatttggtgttctgcatttggtctgccttataatgtagtagtactaatgattgttgttgctactagttttttggatttgaaaagtcatttccattattttttttcttcttgtcaccaaattaatctttttattgttgatggtgattgtcaattttatatcgaagtgttttgttgctactgtttaaggtctgatgcaaaaaaatggttgtgtagtggggacaacagaaactgaagtgcagaaagataatatgttaatatgcagctattttttgagcatttatggtataatcacatccataacatagcatcatcttggtttaagaacaaagcaaagcctctggggactcgtccatactccatagtgcaatgtttaagttacatgttaattgtttttaatgtccatctataaaagactctatgatccactttaccacatgtcattatatgaaccttggtgggctctatatgtcattagccttgcatattgtattgtccctgtcaaataatgaaggtttatgcacgcagagaaaacagggaatagagatgaaataagaactgttgcagttattttgcttctttatttctgaaataatcagtttccatccttgtctcccttgtatgcctacctagtaacacagacaatatcttagtgattttgattttctactgtctctcttccttgtaactgatattttttttctaagcaaggtaatgttagagcaaaagagtgagtatttttccgtttactgggcatcttactgtgtgtatattccaaattgtcaaatgtgtaccggtagtatttgttgaagttttgcagccaaggggaactctcttagctgagattagtatgtgaactcacaagtctcaataagtgtatgcccaaataagctgcttttgagcaatgagttttgataacctagatttaggttcatatttggttgcagtcatgctgtccagtggcatgtttgttgacttaacacgttctacactgttgatagttataaactctatcatgaatgtcattgtttgtgatctttctatattattcccatcaattcattctgtcatcaaaatttatgtccatttatttttggtgcagggttatattgtcctaaatagaccatgggcttttgttcagtggctggagaaagcagatattgaggaagagtaagtgtcttaattctggttttctacaatttttatgctctccaataatgaaatctaagaggcagcacattttatgattggtgcagatatattctgatggcagaacctgaccacatatttgtaaatcctttgcctaatttggctcatggaaccctgcccgcagcatttccatttttctatataaaaccatttgagaatgaaaaaataatcaggaaattctatcctgaggaaaagggtcctgttactgatgttgatccaattggcaattctcctgtaatcattaagaaggcaagtctcaatagtttgcctactgtgcttgattgattatagttgttatactgtgacccatatagctgtaatggttactattacaactattatcagattttcgtgattttttcccataagcaacatattctttcatttaaggcattgaattttttttatcatcagtctttgatggaggaaatagctcccacatgggtaaatatttcattgagaatgaaagatgatccagagactgataaagcttttggatgggtgcttgaaatgtgagtattaccatagaaattcaagattcgggggcttcattttttattgtatttactgatattctttttcattttataatttttcctggaccttggtctgtactaataggtctaaccttctgctgctttgattgtctgttgagtaaaggtatgcttatgctgtggcatctgcattgcatggtgtaaagcataatcttcgaaaagactttatgcttcaggtatgaattgcttgtgttgttttgtaattgttacttaaggaattcatacacaagtccatgacatgcatcattggaatgtttcagccaccttgggatttaaatgttgagaataagtttatcatccactatacatatggatgtgactataatatgaaggtgagtacattctccttaatgcaagaatgatgtgaaaatcaggtagagaaactctatttctgtggttagtattacttttgcagtttagcttatgtctgtccatgtataaaatgtgagtcttgcatgcttagttgttgtatgcgtaagttatctactccttattacttcatccagggggagctgacatatgggaagattggagaatggcgttttgacaagagatcttatcttttgggtcctccacccaaaaacctccctttaccgcctccaggagttcctgaaagcgtggtaagtccatgcttcaaattttctgggtgtcttgctttgaaattattaatcagttgatgttggaaagttgcaatttcccaaacagtctatattagaaaatgtccttcttaacactgattgaccaatcctcttttctcatgtcatttgtgtttttaaatactccaaaaggaggagttttggtgcactctacttatctttcacacttgcctttctatttcagtctccatcattttaactttttgctttgctttattcacccataatttgataaaaatttcttctcattatatctgaatttaaattttagaatgttgattttgcatgttaatttagtaaagaattttacgatggttcatctttctgacagatggctatataaagaaaaggttcattatatgtagctttagtttgtggcaacaattgcaaaggtagtaaaaccgatatattgaagtgcatgccattgccccctgcttccttatggaccatatcattctaacttttgcacgcaaagtgcttcaaataattaaatttacttcagcaaattaccactgcaaaaccgaatcaaacacataggatgcaaatatatacacaggaaatcaactgagtattttcggtagggaatctattttttgatgaggatgaatcatgattgataatgtggctgtttctccaaaattttacttgtgaagatctatgcaatagctgcaattttgttgttgcttttgtcgagtttttttttttttttttttgttgcctatgcccattgatgtcatgttatgccattagtacaagccacaaggtattagaattatccttgtttttgtggcatctattatagcatttggtggaccactggacctcaatggctgagcccaatggaaaatcaattgaatgggaaagattggttgtaagtgttcggtggggttttaatgtgattttacagtctttgctaaaccttcatactagaggtgttttaactgaagcttcattgatgccattttgtgcttcttcaatgattgctagtttttgtcaattaatagatactgcaataatcattttcaggtgcggcttgtaaaaatggtcaatgaggctactgcaaacatacctgaatgggattcattaaataaaagctgagggaaagatgataaaccataaagccagtgattttgagatgaggactacaaatacatgtcaaaatagataagtttaagcaaataggaattgtgataaatacaaatgatattttgtgctttctctgaaaatagtttttattttttctttctttttaatggccagtaaattcttttgcaaactgattgttgtcatagtgcaaccaatggaatgacatcttatccgttttgttttcccccagcttttgtggatgaaactagtatttgcctctcctcactaatgtttctctactagttaaaagcaccaatatttgcataaacccttcaactgcataggcggtttagtaataaataaataaaaggataaggaaaaaagaagtgtgactttaatggaaggcgtttgtaccattatggtgaggtacaagcaagatactaaaaaagtatgagactaatgtaatttatttatgacaaatttagaataaaagttttaatattttgttgtaaacggaaaacatcagttgatataaaaaaattaaatgtgaaaacttcattcattttggaatggagggagaattcgtaatcaatttttttcatgtaaatttgttttggataagtgataatcatgtacctcaaataggattaatctttgattcattggattgaggaatattcatgatttttgatttaggacaaaaaaaataaaaaataaaaatggataaagtaaattattttgaaatcagataaatatttattatttagtttttctaatttgtgcaacattgtattgttgcacacaataataataattaatgacttaattttatcaaatttagattaatatttattactaatgattctttcaaattaatttcttatttagattcatagatttacttctaatcaaaataataaatatctcaatttattaaatagattcattttatatagtatttttgtcttaaaaaataaaaataatatttaaacgtcataatgatattcatcattttttgatttcctataatattttttctttcaaaataatatatcttttctctcccttcagaaaacaataataattacacattctattttctattttatgtgtctcgtttttattgtcttgcatgatataagttggaaatagtagatacacaaatatggtattgttatttttatttcttttaaaataaatgaaaatttgctgaccagagagttgtccaagattggtgaatatgagtttttttttgtgattgttcaccttcgtcctagaatacaaattatatttgatttctttatagatactataggaaaaaaatagagaaaaaaatgaattagttttaacttgtgtacctgacttttctagaaggtacctcatctgacttctccaaaagtttataagttattttaacttataaaaaagctcaatttgttttaccttcattttttttcctttttttatcccttttttatcggcaaaattatatctaaaaaggttgggcataagtgttattggataagtttatctaaaaagagtcttaattttatataattagaaaagttatgccatcataatttgatcacaacttaaagtagtaagtagttgcttgttgtctgtaaaataggtaaaatcggttatataatgtaggtagagataggtcatcttgcatatttagggttgttggttatggtatcaaaaaatatttacttgcttgaaagcatcactgtctcttgggtgactcccaattccaacccaataccatctaccctttttaatatatgtcttccggaaagataatatctttaatgcaattactttggcagttgttggctcaaagtagacctggtacgcttcgacatgatgaaattccaaacgcaatgtctgatgatctcagaggatgaacaagctaagctactaccattcccaacccctctcaggaagagaagacagacagtttctcacgagtttaaatattcattgtatgttgttcatattaggataaatgagtctaactctttccatccaccttctgttatttcttgttaaactagacaaacagtaacacaaaggaattgcatttaagtaactgctgcatgctacttctgaacaacaaaagcaataaatcacagcagcaggaaataaagagagacagttaaatccctactttagataaatatatttcctatgtagaccaagacatatccacaatccaccatccaacaaggattacttattcataagttagagtaaaacccgactaggtaaaagggagaaagtaaaccgtatgtatatcgctggttatataaacacataagaatcttaacaaagatgcgaccactagacacttgtgcttactctgttactcaagcatgcttcacaaagtcattatcctatcccattatccaacttaaacgagcgcttcatacctaccaatcttcccaactagtctgaagctttgaggtagtaaaaaaaggggctagcatcatgtatcaccggcatagatgacggtaacaattcttacaggcgcatggcaaaccattatgacatttccactggagaagtgaacaaaccatagtcataccaccaatcttagaagatacatacaagctccaagatgactagattttatttatcaccctctatccaccctaaagatgtttgtttatcttcaatcacccggacttgagagctcagcaaattctacaataatatacaagcaaattatgtaagagtaagttcagcagttaacacataatgaccgatcaacagttcagaagatacagatatgaatcctagtacttcccaacactgtttatgaagatggtaatagaggaagtggatacgtgtggcacacaaattgtccaaatttcaatttttgcgagttttaaacataaatgagtaaaataataatttggtacccacctttttgtagtagcaacctcctgcaacatgtctaggccagataaactccaacaaaattcaatgacaaggcagtagaattggagtttgaaggggtagttgtaataatccttcaaggacctcaaatatgtaattatgttagcaatccaaaaaattaacaaaatgaaaggcataaacaaacagcaatataataggggtgttcacatactgaaatggatcagttttgaagagaaatattatctagtccagttacttcagttttcttaatttatcattcaattagattggtttaaaatttaaattcaaccaaatgattccaatccaatctataaagcagtttgaatcgaatcagctttcattttttaaatagtaacacataataaatataataaaaaataatttaaaatatcaaatatctcatctataagtcaatatatagctaatagtagtataactcttcaaatatatactattaaaaataaatttacacagcttaataattatatttagatacctttgctcaattatgtgataatttttacaaaaaatataagaaatgaaaatgtaactatgagtgatatcataaattttaaaataatatatgtgtgtgtgtataatttcagtttgaattgagtaagttttcaaaatcaaatctgaaatataatcagcagtttattaatacccctaccaataaatccagatgggaagcataccatcaatattctcatactgacaagcagcatcacacaaagtattgacctgtccagattgactgtccttgaaattgatcaggcagtggagtaaaatgctgatttccatttgggagcaactgtgactgcaactgctgattatggtgtgcttttaaaagctccaaagtctgaaaatcttgccaaccattctgtttctccacctgcagtgtagatggaatttgttttccaggcaagggaaaactggctgtcccactcaaaccactgttaccaacttgatgagaatttgactgagagtaagtaagaggaccattagggcctaaaccattggttgatgcaggcaactgatataccatccaaccaactgtaatcatccataattggattcccactaatcgaatctgaaacagtgggttcactacattgtttaggaggaacatgactgaaaccaggaggaggaccaaggtgcctagaaggtcggctgactggagattttttaaaaccagcttgcaaggttgatgatgttttcacaacagagttatcagtgaatgttccagaagatgcaatggcctcaattttggatgatattgcaaagtcttcagcttttgagagatcatgaggataaaacatactagttctagcacttacagattgctgggtaggaactgcaagtgcagcatagtcagagattgtcgcagctgctttaaatggtaagtcaggtttcatcacatgcccattctccaagaatctaagacctttcaaactgttagcaagagatatttcctcctctaaccaccaccttgaagaatgtggctgaactagttgcaggtgttgaggcaccatagcactaacagaagcaggtaaagaaatttgatgattcacatcattcagagggttagaagtagaattaaagttaaattttatatccccaatagaagccattggagctggttctaagccttcatgtggtgcccgtgatgaggaaacaaccacatcagcttgtttatcagctactataggtttgaaaacaataacctcgtcatcctcctctccttcaatgtactgatggtggtctggactaccaatttcgacttttgtcttgtctattactgtgttgtctttcaataaatcttctgcattaggcatacctgaataggaggaaatcacaaaatcatctgagatttgaggctgaactccaattacaaatttatttcccttttgagtcaaaatatatcattttctgatcaatcctaacaacattggctaaagcctttcctgctgctaaaatccttttgacccgaccttttctttccttttcactgtcacttccaatggaattcttccttgaaaaatccaagatggtttgtgcagggagaagtggaccaaatcctcttaactcaaaatcctcccacagagcaagccggttttcagtttccccttcttcatacctgctcatgttattaaagcaagtctcctcttcattttcaatagacatggaccaaactgaaagtagcttgttcaagaaggatacacaatgattccaaaattttgatctaacagttgcctgattctcatctacatcattgcctgcagcatgatatggataacatgccaaccactcaacaaaaaccaaaatgcctggtaagagataactacaagaaggatcccacagctgcatacatctctctactactaaactcatcaattcgaaagctgcggtgaatgcattctgaagtagaacagcacgctgtacaatttctgcatatgtttgaccttcagattccttattcacattatgaactgtaaatatgatagtggaaacaactctgacaatggccagtttgttctcaagagtatctgtgccaaaattcagctcttcgtcttgccctgatgatagaagctcacgcaggccagcgctaacaagagagagaacttcagtgagggtctcaaggctatcatcacaatatatgagaaacaaagaaaaggaaaaaagtcagaatgtaataatccttaataattttatgcatatgatggtcagatagaatttgtgcattaatatataccttgtatgagtgaataagattccatttagacggacaaggcgcgtgcagaaggatttgtaagtgtcctgtatattggataatcctccctttctacaagacgtttccacaccagtatccctggtcatgagttttgcttccccttttcctcttccattgactgcaagagcgttaacatcaccagaaagctgggagtaactttggtgattctatcatggtattataaaatagatagttagaagtaatgccaaaaagatcatatatatgacaaaaggggaagagtcaacaacacataccacagtatgaaaataaacagaggatcaagctcaagagctaattcttgacccccaaccatgccaaataaacagaactcctttatgtgaaaaggtatgctgggttgcagttttcaataatatcaaatataattgcatacttataatgccatacacaaactccaccttacacgtcccaatgcttgaataacttgcaagccactgagaaatttaaaacttataaacttccaatgcatttacctttgagtaccaaacactacaagtagcagaaaagactgaacttgatacatcatacttaagtttgcgagtaagcaaaaacacataaaaaaacaaaaacaagatacatctcaaacaattgagacttctaaatgaaaaaaaatgcaaaactatcaaattatccctggcagttgtaaatggactatccacagccaaactcttaaaataacaataaacagctgccagttcatacccatgttcatattaccttctcaaatgcaactatcaaattatccctggcagttgtaaatggactatccacagccaaactccgaaaataacaataaatagctgccagctcatccccagaatatgaagccaacaaagcaagctgaaaataacagacttgtcaaaatggaatacagtagctacaaaccatgatcaacaacaaatgtgaacaaccaaaagcaaagcacatgagagacaggaatgccaaaaacctgatgatggggatttccacttgaaggccaaatagctgcagcttgtaaatagtaactagaagctgctgcaaactcacgctttatcgagtcaccttcaccatataagcctttgtagcgtgcaagatcacccaagtatatcaaacactgatgacaagaaattaaacctttcttcatctcagaagatttttttccatccttctctgtgacaattttattctccgagtcctcaaagtaaccaagtggaagcccatactttgctctgattttcataatcagatcatggtaaaatccagttgcttctgaaaggaaagtcttaaactgcagccttattttagttatccggtcaggtcgaacaggacctttccctccctgagatgattttgagcttacagaagcatgagcagcattaaagtatgccctcaattcctcaatccgcttataatgcaattgccacagagcatactcaatattgtactgctcagaaaaagcatgatcctcaagaattattgcttcataattctcacgaatctgctgccaagcatttggatcagatgggacctgtgcctgagcagatctccttcgcttattctccaattcaaggttctaagagagaaaaatattgagattaaaaatatatcttttgtattcattccacagaaggtactaataacaaggtccagcaataattccaaacaatgtcatagtaaagagagcaaacccaaccctgcaaagtggggttatcttcccaatagaggaagaagaataacaccaattaatcaaacccaaacctctaaagtctaaaaggatcaatgaacaccaaaaaatgtcctccaaagtgaaacttctatatgcagatacactgtaccaagagtacaattgagctaattaagattaaccagattcctttacatttggcagattacgagagattcacatggataagctcttttccagtaataacatccgtgataattatgacacagagagagagagagagaggtgtacctcctcataaaggcgttgtgcacgctcccgtgaggaaggagcagacactttatccatctctaccatagggactaaactctagctacataaaacctaaaaacaaaaaatgaaacaaaatagctcagttcacaatagctcagttcaaagagtcaggttttaagtaactgagataaaaagtagagtaaattacacccgcaacccttgtgtttttctcaaattgcaccagacacccctccctttttatacattacttttacccccttctattaacgtcgttaaataacgtcgattgaaacatctaagaagacgaaattgcccgttgagtaaattacacttgcgtcccctatgtttttttcaaattacattcgatacccctccctttttatacattacttttaccccttctgttaacgctgttaactaacgtcaatgtctagggaaccagacccagcggtgatggtggccgtagttacggcggaggacgaggaggtggatatggcagtgactacggtggtagtggttgctctagcgggagtgggtgcgcccggacgccgtattggtgggcgaggatgacaatgaggagaaagagatgatgatgccgtgggagagggaggaggaggagaaggaggtggtggtggtaagtgaagaggagtcgttgaagaagaggagggtttgtaaaactcaagatgtgattttgaggaagaagatgagggtattttaaacattatttttcgttaaaagtcgggtgactatcatgtgtctattttctgttaaattattaaacaatgtttaggagggaaggagtttgggtgtaatgtgacctaaacaattaaggatgtttttgtaagatgtaaaaaatgagggttatcaagtgcaattaggaaaaaaaaaaacagtgcgagtgtaatttactttaataagtaacatggctgttgtggcaccaaaatgcgtcacattatacaaagtacccattaaaattgaaattcaaagctataattcaataaaacaagagttattccaatttgacccccttaatgagggattaacaactaagtgataaaaaattcaaaataaagcttgggtgaaaactctacttaatcacatacgattccaaacatcaagttgaacatttgagctctgaacacacacaatcagagtcgaaaagcaaaattaaatgtaccaaatgattcaattccaaaaacaactttccatcagtttcccactgataaagcagttgcatggaattcgatataggaagaaacaacaccagatccatgaaattgaattcaataacgatacaatatgtttaagcgaataagcaacacaataacaataaaggatgagcgcattgaaaaaacgggagaggaaggtttgatcgctcaataaaagaattggaaaagggaaaatcacctgtgaaagaggatagaagaatcgatcaaaggggaagtgttggtctttggtagggtttggttgtgttttatgagagagagagagagaagaagaagaagaagaaggaaggaggagggaggcgtggaagtggttgtgttgttgtgttggatggtcgtaaagggataacgcgtctttctctgtttccatgcagaagacaaatcactaacgacgtcgtttagacctccgtttttcaactttgccctcacccttatcttttttttcttattagatgaacgtattatatattactagtagtgtttgtttagtcattgtataatcaattttattatttttttttgagagagaaatatcggatgttcaaaaatcatgagattaattgtgcagacagagaaattattgaaaagtgggttatattttttctaaaaaaatattttccaggtacacgtccaatagtaaattaaattcatatttaaagaagtcagttatttatcaattatgttggactttatgggtattaatttttttataaaaaaatatttacatcacattattaaaataaatactaattaacatataaattgtaaggaaaaatatttataaatgaattaaaattataaaattacttatatttcactatattttttatataaaaaaaaattgtttgtgtagagtatttaacttagttgattagttgattaaatagtatgcacaaattgttataaatttataatatatgagtttataaaaaatgtttgttaatgtaatgtaatgcaacatataatttatttttgacaaaagaaagacactattgtgacttttttttttttgtcaaatgaaatttaagaaaataaggtataggaagttcacaaggcacaccatatttctaataccttcaaatactattgtaattttaaatactggtggtttatttcttttatgatttttctaattttgcaaagttttgtatatatattttattaaagtttctttttagtatacataaaatagaagaaaactgttaagtagtaaaagttgttattaaaagtttcttcacgtttttagtctcgagtctaaattgagacactcttgcctcaatggtgtaacacttagggattgttagtgccccttaccaatattctcaaattccaaaaatatcatttctcacaattgtgattttttttaaaaattttttacacttctactagtttagcattaattaagaaaatacaacgaaagtataactttcgttatacattatataatacaatcaaattttcgttgtacattattttttctgaaaaaaagcacaataaaagtataatttagatatataaattattacacaatgaaatcatactttccattgtgtatcaatttatataacacaacaaaatcataatttgtttaggaaagaaacattcatgctatgggctaaaagcaattttggagggctgatatcaattcctaacaatattgatatgttaggccgagattttgaactttcaaaacccgtagatggttagattaacaatgggccgagttttgacgatttctattatcaatgcatttttttgtatttttactttatttttctgaccaaaataatattttgcatttgagaattgagaatctttcttattcaacaccaccacggaccaccacttccggcgaccatttccaactaattccggcgacgccacgctcccgacaccggtgacctctctacctctcaccgaacgagtgaacgtgcatcttaattttttttttttttctgtttatgattatggatcgatttgtttctgttactgaaaccaaagatgtgggatcccaccgcttcacttcagttctctttcactacgctttcatttttcaaatcccgaacgttctctttctctgaatcgctcggttcaaattcacattcaatttcgaaggattttcttcaccagaattcatagcagtagcatgcactacgtaacttcgttttcatcggaggtgtcactgaagtagaggcgttgaatattttctcaatcgttgttaaaatgcttagccaccgaggaggataattgttaattgcgctgccaatccgtgttctcaatcgttattctacggaaatttgattattcaaaattcgagaaagctcgaaaatatttatgtagaagtaaaagtggctatatgactagtatctgagcaaatttctttttgcgtttagtaattttagctttctaattgttattattattattattattattattattattattattattattattattattattattattattattattattattattattattattattattatttatttgcatctgttttccatttttttaatgtgattttaaccgtaccttatgcaacacttgtagccaatattgaatgtatgtgatgctttagtttaattttgaatagcttaatagatctagtgcttagtactgtattagtttttgtggagactttaattctggtttctatggcttgggttttgatcctgtaagtattattggggtaggttaaggtgtgagtgtgagtaaagggtgtagcgaaatagccttcaatattttagccctggattaggtattgactatttggtaattagaatgctatacttgaaatgtttgcagataaaatttatgtttggtcttcatttctttcttgacttgcgttttgcctttaggctaaatgagtggaaaatgtgcaatttagttaaagaaaatgttggttatcacttgttaatgcatagtggggttccaaaatttggaaaaaatcaagactattcttgcataatttattgattagagaagaatgttgttggtatcagttgttcaagttgactaactgatgtgggctttcagaatgactcgaaattttggtttgacagttgtacattgtacgcacatcttcttcatggatcattgtagttgcccttctattacacagttatacttgaattgctataacagtaaaacatcaaattgctttgctactattttaaacttttgttacttatactgttgcctgtgcttttctctgaacacaagcaactttatatccgagaactatttcgattgaaaaactgatattttatgggcggttaaattaaagtttagcacatgctttgttctgtgaacattgcagttggttgtcgcaggattttttctttgattaagatttcccatggtggtagtgttgcaatatagccttagcctataaattaaactgtccataaagaatatgattccactcatttattaaccgagtttggttatttaattgtgtttcagcaagggcaaggtgcttgaacatctgaattgtttgcaaaatggtttcctttgagatgaatgatcgaaagagtaagtgttatataatatttttgttcttatatcaagaaaatgatattatatgaagtgatctgttgtctttaatgcttatgtgtgagaataaattattggggtgttagctataattccataaacatattagacagggtagccatttttataatttaatgttaattacccaattctcttgtcaaagggcgagccctgacacagcggtaaagttgtgtcttggtgacttgttggtcatgagttcgaatccgaaaacagcctctttgcatatgcaaggggtaaggctgcgtacaatatcccttccccttacctgcgcatagcgtagagcctccgggcaatggggtacgtagttttttacccaattctcttgtcaaaagtaatatgattgtaattttataggaatattttttttcttaaaattggttatttaaaagtaatgacatcacctaatgatgctaattgaaatcttccaataatggcattgcttatcacattgtaagtaatggtattccaatccatcatgctgattttcttcagggtcttgggggaaagacatctttaagatgtatgttattagtttgcctagtaataatattaatagagttttcaagaaacatattagtgtctttatgttgtggtatcatacttgctggcataaggattgatttgaccaaactgtactatttttctacattacgttttttatatctactacaattttgttattgctatatttaatgtatttgattggcacatgatacagagattggattaggattaactggctttggtatatttttttcattccttggaattatcttcttcttcgacaagggattgctagccatgggaaatgtaagatttgtctacgagttacttgttatagaagtttcttctcatttaatttacttaatacatctttttttacaccttgttatctgcatgattagatcctgtttgtttctggagtgtccataaccattgggctaaaatccactatgcaattcttcatgaaacgaagtaatttcaaggtaaacttgttacatgtcttttcacttggtgcatcatgctttcttcatggtaaattttccctgctcaccttttactcttcttaaagggaacaatctcatttggtgtcgggttctttattctcatcatgggatggcctatattgggcatgattgttgaggcttacggattcatcgtactattcaggtttggtgcaatttgaaagaaatctgttgtgtttgagtatgtctgtatgcttaaagctaattgtggattatactgtgcagtggtttctggcctacactggctgttttcttacagaagattcctgttcttggttggttgtttcaacaaccatttgttcgatcggtatgtatttgtgatgaatggaaatgcgttaacctgtcatctaagtcttcacaaaagtatcttacacatttaccagtctcggtgctaccttatcaataattggtgttcatgaaagttatcaagaaatctttactcactttgattgattggagaatattgattttcattaatagatgtgaatgatagtgagatattgggtatagaggaaaagcaacagtgtttagtgaatgtcaaactaaagtcttctgatgctgaatttagaaaaaagagctttaagtttaggcctaaaaacattttcactttttcaatgaggctacgatgaactacaaatgaagccatacagtcctctgaattttttggggggtggaggtggctgatccatttttgcatgtatttttttataaaactttcatcattgtgttcatttttttaacataatcctggtgggtcttgatgaggaatctgacattaattgttggttctatatatctgtctagagattgttgagtgatacttcttctgtgtaaatgaaattgtccaactgagctttgctaattttctgtgtttttgcagttgtttgaccgctatagaggcaagcgaatgcctgtgtaacacaagaatctatgaaaacatcatgtaactagtagtgactgcatttgtaagtcaatgtaaagaaaatactcgtatggatatctaactgatttgagtttgctttttgatggtagaaaatggttatcattttatcatggtagtcatttaatggaaagaaatttgcaaagggaaaaggtttcagttttcactttacttcttgtttggctcctaatgattctaatgcttggtggaaatggggagtggttagttccatctacgtgactattccaatcagacacctttgggagttgtccccaccaagtatcatggtggcttttgttcaaacccgtaaaagaagtataatggttacattacttgatgtcattgcagcaatatagttagaactctgcagtgtaatttactctaaatattttacatttactcccatgtcttctattgtttctttggaattgcgtatgttttctttttaggctgagttgtgttattcatataacaactcatatttatacaacattttatttatgtctctctctattatggtcaattcttcaagtctatacaaatggtgatcttgagtggtttcagaaaactcttttggtaatataaattatccttcgcattacctctaaaccaatttgtttatcgttgaaaaagtttaaagttttgtgaacactgatgtgttcattaacactagagacaaagaaattaaagagaaatgtgataaatataataagagatataatgtaataaaaagaaagagatgttggatgttaaatgtatgtttgtaataaaagtgtatgtatcattaattttgaagaaatatgatgttaaaagtattttcttattggttgaatactatagttatatattgttaaaacaagaaatacatcaggattaatctattgaacatttgaatacacttaaataataatagtaaattttaataattatccactaatagtaataatataaaatagttttatattattatttaattataaatcaccggtgttaactctaaggtaactgataccaaagtcaataatctgtcaataatatagcattttttttatctcaataataatataacatgtaaagaaatatcataaatacaatcagaagtaagcaaaaacatcaaactgtttgagaaaaattgaaccaagccacatttaaaaaacagttggattcaaacaaaaccattttcataaagtggttcatatcaaatttttttaaaaaaacctatacatgtgtgaaataaataactgaactagaccaaattgtactgttctatttgaatattaattgctgcattggtttcaacgacaaaagagcaaccattttacaaatacttaagggtaaatattaatatttttttaaaggccagtattaattgttaattttttattttttgttagcaagaaaaattcaaacctacaacatctccctcttctcttctcccactaaatcaactttatatctcccaataaatacaaattgttaaccatgcctatcttaaaaacgaattcaataaaataaaacgaacaagactcgcctaacatgctaagttttccatgctttagagatgattttaggaaagtcagaatacgcaggagtaaaaagctgagcgttatactaaagaaataatttaatagcatcacaaacaaccagctagatacataacaataacatacataccaatcattccacataggtgacataaactggcaattgcatgtccctatgtacaaagaatttgccaaaacggtaattaaaatttcttcactttagctgtttgttcaacaaaattccccatctattgacatgccatataattacaccaaattccaccccctcccctaaagaaacaaaagaactcaatgttattaaaaaaagagaaaacctgaagaccaaaaggaaagcctttcatttcaacttcaatgaacttcactaccaaaagaagaaattaaataggaaccaagagaatgaagcagtacacagacccatgaaggataaaaatatatgcaataagtcagactcaaaggatatacaacatgtcagccaaaattcttccccacggattttatgaagcacctattatttggccagtcaactccacgacggcgaagacggtttatagacaaagtcttgggaagtcgtagaaccataattcaaatcaaggttatggagctgttccatcaactgggatcgccgttccttgaaaaagtcaagacgagtagttaactctactagtgttgaagatgctacagatggatgtcttgcatattcccccacctgaaaccattgcaactaggttagttccaaattatttggaagcagataaagatgctgcaaaaatgtattagcaaagtaattatgatactcatctgacaatgaaaaaaagttgttactagaattatgcataattccaagaaacatttctttaacttaattcttacctctgctgctcttgaggtggagggcacagaagccgaatcaacggcaccgagatcatcgacagacatgcttgttgatgcctcagtacttttggaatcgctaggacttgactctaaaaattgctttcgagaaggctgtctagtaccattaccagatgccaatacttgtcctttgatatttctccaatcagtgcccaacaaactctcctgcatatatgaaaaggcaaccttgttgaagaggctccaaagtccaaaccataaaagaagatatcatccataagtaatgaactaattttatcataaaaaaaaactaataaaaaatgatagatccctaaattagagaggaaagtgctgcaaccagtgacaattttggatcagaagcattttggattctaataccctaaagaaatgaatccagtaataaaattcctgatttgtgccaccattctatatcatttttcatggtcatgatgagaataagttttacaataaaagcaaagaaaagaacttgacatgtttctcgattagaggttaattatggaactaacttgtgtgtaataatgtatcaactcatgtaattatttaatactaacagaaggagttgaaaggattggactaacatagggaagattcaaccatcttcctgattgtttttccttttagttttgattttgagaaatagactataagacatacctcagtcctttgtttcctctcgtgattaacaaaggccagggttgaatcaaaatcttgctgaagaaacctcctgcacaagtcaaaaagacttaaataactactaaaggagttaaaaggttcacatggctttcaattaaaaactggtcccataaactttaaagaaatgcagcaacaaactagtgtttgagtctggaaaaggcaaattattgttaaaactttaaaatgattaccatagaatgaatacaaacacacatgcagaggatacagtcatacaaaccaccctttattatggatacaaggaaaaagagaaaattggaaatattacaacatttcatctcctttttttaggaaaatttctctaactccaatattttgtgtgtcaactttagtgggtacttatccatttgaagttggaatatgtcagtagaccctttgctagttaaattggatttggtgtcaaattcatgtggaactagcaccaatttgaattttgaagtacatcaaaagctgtaatagttaatacttaaattttcatatgtagattccttctctttcttattattacaaatatcataggtctgcatactcactgttgaggatgattttgggcatgttggtatcgatcacccacatcagtaagtgaaccatagtgatgctgtcgttgctgattaagttgatgatggagttctgcaaccttctgcttcaaccgggccacatcagcttcagcaagtgcaatctcctccagctcagcctttgtctgtacaatagcagattttttacagaatgtgtactgagaaagccatcaaaagggaaaacgaatattaaaatttacaaaaatatcaaatcaccttggaatccatgccacgtgaactggaaagctgtcctgaagacatgctcaagcctacttccaatgcagctctaagatccctctcagcttgcaactgttcttgcaatcttgaaacctgtagattaaaaaatcagttgcatcttattatgggatcaaaattataatgaggggatttatatccatttgaatttaaaaaagaaaataaagaaaatatgagggataaaagacttttacatatttactttcaaaagaaacaataaccatcaaacaggacacatactattgaacgaaaagaaagatatggcacaatttttggccctagtgattataaaatcctgagcttcagtcagcagaagtataccttcaaaagagctttaaaatgccattcagaatataaaagaaaaaacatttttccaatatggaaaacccttccagcaagtaacactttaaattatattttttgataaacctccattagtgtagaatgcattttatccatatcataaatcaatgtaaagcggttccattattaacaaccacatcttgcataagttgtagtaatacacaaggaaaattcattagaaaccatttttggtttctgcaagaatattttaatcaatttaaattcaagggtgaaatcaatttaaagaaaaaaaacagcaaaaatgatgtcaggaatgtcaaacccaagaatgtccagaaaatgaaatcacatgccacattaaaaacaagcagcaaagcacagggcaaaccagcaaattaaatttaaacagttacaattcatattggagggagatatatcaatatgtacatcttgttcaagtgccaagcgccgctcatgtaaagcttgcttccttctctctaagcttgcttgtaaaattgcattgcctctagcctaaaatgaaaataagaccaattccattaaaaaaaattattcgttatatgattcagcataaaaataagtaggcataagaaatccacctcctttgcaattctgtgttgcaaatcactttttgcaatctctagtctctgaatagcaagcctacaggcatcaaaagtattagttatttgttttcaaggtataaaattgaaagaagaaaaaaaggtgaaaaaaggaagacaggtataaagcaaatcacgtaatgcaaggagataacaaaacatagctgttacagctgatgaaaaaagccaagctagagaacctaacaccacctatccaaaaaatctataagaagacattgaagaataacttggaattctatcaagaatcacaatccaagagcacattatacaaagaaaaaagtacaaagctaagtatcttactcctcttctccagaagaatcaacggattccactgatggtgtcttccttggctgcttaaatcaaaacaaattatcagatgccatgtatttaccttgaaaattcaaaactacaatagaaaatatcagttttgcttcacataacataatttaagtatatccactgctagcatattaactctgcatcagttttgcctcacataacataatttaagtatatccactgctagcatattaagtctgcatattttaatggcagcttattgcaaatatattgtcagtaactcagtatcacataaatgtatgattgtcctataaatggttgttagtgtaattgtgattcctgtaacaactcacattctatattcacactgagtttagatatcctacaaagttgttaggctgtaaatggtcaaaaaataacaactcacattgctccttccccagaatgccgaccgcttagaactgaaactagcgctactagctttacttgtttgctttccagaacctgattccatcactggcatgggcaaaaggttgccggggtccatagaagataaaatctcacccatggatcgataagattcagttgaaggcaacaaatttgaagcatcattctcatcaactggattttcactgccctttctttgcttgttttgatcctcagacagtggtggggtatctgaaacagcattcagattagcattttcagtcttagcatggttactactggaggatccaacatctgaatcatcacctccaaatgcctgcaggaccacaaagaagagtttaagaggatagagagaaaagaaaataacattgctactcatggcaagagcttaatcaatataaatctctataacagagaaaataacattgcaggagataaccttgtaatcataaagatcactgccagcataaccactactctcactcaattttccactctgaatacgatcagcatcatcatctgtctcctgatcaacttcattctccgcatcatggtaaccattttctttcacatctatattatcatcatcagtagaatcttcactcccactgttttcaacctgagaatctgctgacatggaacatctctgtatattttcttcctgaaacagcagataaaaactaaggttgtagaattgaatcaaggaaagaaaatatacatttttggaagtgcaaaatttagcaaacactgccaactgaccacgggtaaatcattagtcacatgaattgacattcaattttagttgcattataggaacaatgtatgctacaagaggtcaaacctttttagctcattatacaatctacggattgaaatttatagcaacagttaacttgatgaacaagtcccgtagcaaaacttcatagtaagtttgcatcttcggtacaagcaaaagaatcccatataaggaccaaaaaaagggtgagcccaagagtaatcaggatacctcaggctaaacaaaacataaatgaaggttatgcagcaacttgaagttaattttcctaattgtaatcatacacaaaccagaaagcaaataatcaaaagaatacaaattgattgagagtttcttacatcaaatatattctcatactcctctaacaaagttgtaataactgcttgagcattattagcagcattagcagcagcaagaagctgggccgaactatcaccactggcatcaaattcatcctccagttcacattctccagctagcagaggccgtaagagcaagggtgccatgcaagcagcaacagcagatggagtcattctattctcctgagaatgagaaccaattgtatgcatcatcttcagaattctgcaaaggtagagataacaattaaattatggtgaaaaaattaagggtatttgtttttgtcattttaagattatacaagtgcatttctcagattaagcaggctacaaatttaaggtattattattacatatcaacataataataactgcaacaggttattcctcatcaccagatattatcaacaacaataaagccttatctcactaggtgaggtcggctacatggatcacacaacgccattcggcacagttaaaaaccaaagtttcagaaatattattaagtctgagatctcccttgatgatttcttccaacgtccattttggtttccctcttctccttttcctgggctaaaaaatcatgcaatctactctgctaattggcgcttcttgtggccttctttgtacatgccgaaaccaccttaaccgattttgtcatcttttcctcaatgggtgttacaccaatcttctatcatatcaccagatattatcataggttacaaatatcttagggtaagatagtgaaaacttcattgaattgtagtttttagaggcttttttcttaaagccacataaacctgaacaaaactccaaaaacataaaggttctaacttaaaatgaaaccaaacagaaatcaagaaaacccaatatacattctcttcaagtgcaatttttaattattctaccataattattccatagcaaactcaaatacaagaacaagatacaacaaatggaaagaatagtgtgtgtgtgtgtgtcattgccaaggcagcggggaggagagagagagagagagagagagagatagagagagcacctctgtaacaaacgtcgatttggctctggaaaagtctccaatatagcacagcgcattgcattaatcctagcttccttgcgatcaatttcttgtaaaataaaaacagtaacaattaactcaagcatatattcacatccagagaacaagataaaagcaacaaaattcaacaactgaacaatttgtgatggaaagtacataagcattagacatatcaacataagcaaatttacacatccaagataagaagcaaataaagttaaaatgagggggaaaaaataggtgagatttaaataggacagtcaatgatagtaactgacatcaaacacaaatttaaagtagcttttaagccacataaaaaagtgggccaaacatagctgaactcatccacacgtttcaatatttcacagcaaattttcaacattaacagcttttttaaaaaaagaaaaaggataagttgttatattttccaaaggtcaaacatattccataaaaaaatagaaggaaaaaaaagcaaaataaatagagcaattagcagcatttcaaaagaacaaaactaaaccacctattcagagcatatagtcataaagaaattaaacatagagctcaacttactataagcctccaacaaagcagtgcagcatgaagctggaactggagaagagggcagctcccttagaacatgctgtaaatatacccagtggattgtcattaattaaaatgcataatccaacaaaacattttaaaaatccaggatccgtattaattagattgattttaccaaaataatagctgctccaattcaggttctattaatcttttatgctgatggaagaatgcatgattgattacaggtcatggcctcaaggtcttaattgtaagcacagaaaaactattaaaaaagcctggtgctcttatattaataaattttacgaagtacaccagatttcatttagattgtacaggcttttagactagaagctaataggtgatactgatgagtacttgaataaaaggggggtttgctactgccggtaatgatatgtaaaacaaaaaattgcggctgcaatgtttctttcagaagcacacaacagctttataaatggtcctccagcaattcgttagtgtgatctttaatagctattatgactgatatctaatatgtaagtagggtcggtggttttaagactggttgcatgaacatgatggtttggcactagaaatcttcccaaaatttaactcatttttatgcctttcttcccagatcagcattcagtctctttcagaatttttacctagtagacaatagacatgcagagcaatggagctcttttacactaataattaatgtgattgtcagtttttgatttaatgtttttgttctgcgctcaattgcttctatgtttaaggaggatttcttatcctatttcttgtgtagtccttctttaaaataaacagaaaaagtttctggaaagcttaaactttactttacgtaaaattgagatcaataattctctgtacccactgttgaatgatgtgtaggttagatactaccatatttcctacttcctagtgtttgtaggcatgacaaatattagatagaggattttcttctccatgattagagttcaacatatagtttgcttttttccacaaatatttatgttcattaaataaccaatgatggaaaactagtataaataccttaacacagtcaccaacaacatgggcatcctcctcaggaccaaattcagtcttgcctggaaatatcaattaagaacaaggcattcataagtttcatgtatcaaaaaataaatccatatattaaactgagtgtctacgtctggatattatctttactggtctttcaccaacagaagggttgaactacaaaaatattcataacatcggttctatatagacggtggctgattctaaaagtagccagcataatttataacataaattggatggcaagaaagaacaactacttcagaacaatataaagttcttgaaaaggtgcatagatatgcttggttagaaatctcttctacccctctctaaacagctttttgtaatttttgatgatcaggatttatgaaagttagatttcctttcccctatgtttttttctctccttgctgtttccccaatgaacttcattgctattttttttcttgaagcccaattaacttcattaacgttctctgtaccaagtaccaacaacctactctcttcaaatgcatgtaaagtgctaggacgtttaagataactgtttgtaccttgttcatattcttgaactctcctatctacttcctccacatctgcagactgtcgcagtattccttcaactttagttcctgcaaattaaaaatagtaaaatcagcagaagcccttcactgaaaaatagggtagaagtcgtgcattcaacatttttctttgtcattatgcagtcagatgcttttgcagaaagccatatcaacatcacatggaaggcactcaaattattaaacaaaggaatcatctgctttgctgatagatgagctttagtgtccaatgtgcttcaataattgcacaccaatgttgctatttaacgattaagtagcttaatttacaacattttaaatcacaggctattctccaaagggtcaaggttgaagaggtaatttgcattttaacgtaatacataacacgaccaataaagaaaaaccaaaatatccaatgcaacatgatctccagttgaacaaaatattggaaaacttaagcacagggttcacttatccagacagaccgactagccaacaaattttgaacaaactgcctatagagaaataaaactgaacaagtaactcctaaaatttgaatcatgagaggagaaaaagtgaaatgaaatgcagatgcatcacatatataatagaagatcataacttaccatacttctctagaaaccgaagagctttttcaaggaaagatgggcctccatcgatatcttctagtgccagcagaattggtcttccaacaaccagagacttaattggacgtttgtccctccctggaagcaccgcacaaaatatagtgaaaatgaggacagatttttttctattgaaaaagaaggatgacaaaaatccgtaaaaacctataaataaaatgttaagaaatttaaaataaaaaacacagaatcctagcaacaccagaattgacctataactaatataagctagtaaacataaaatgaataagatttaaggaataatgagcacatacattgatggaaagacccttcaatagaatcacttgcgtcactccgaaaaatcccattgtgtcccataacaagggcagcacttggtgcctgtgcgagggcttgttcaagagctgtcttccattcaagcaggtcttctgatgtctcagcctgatatttgagaaaacaatcagaatttatatggcccaacaattaaaaagacattaagaagtagtacaattgaatttaattctcattcacttaaaaatataataaacacatcaccttaagggtgaatgctcgcccatcacgtccatctggaaataataccgtaagaagctttttgtcttctctaactacaacactggaaaataaaattcacaacttttagacagattgacaccaaaatttacaactacaaaaaatcaatttatccaacatacctccctgaattgtttaagtcaataccccccaatgtcaggtttacttcaccacctctctgtggaagggcactctacatgaccaatcaaagtaaagacaattataaataataacaacaaaagtaacttgatatttaatatattagagtaaaataaatcagcaccaatagctaagacttttatagtattattcaattctctgttagtctacagtcacttattactctccaataagaactgtaaagtaaataaaatgtcatttttccaaaacatatcagcacaaagtatatccataaaatgttaattagttcatatatcaagaaagcttaatcaatcactatattaatttttgttatcaaaatcatgatctgtaaccatatctgcttaattgagaattgaatcacacagaacaacagaacacaaaaagatatcaaataaagatcatagcaagaatgagaaagatttgagagatactaacaggatcatttttgaaaaagaccaatgacgtgcgtgtgagtataaaccaccgcttcttccaagacttccagcctattcctacagaagatcaaaatgggataacattgataaattcctatatcattgattaatttgaatataataaataccatcaacagagaacagaaatgttaggtactccccattagtagatagttacaataggtcagtagttgcctatctattagttatagagcttaatggtcatgcactgacggtgcaaaatagttttacactatcatacaattacaaatcatcgttgatatgacttcttaggtatatttattgtaaaagttaacaaacttaccataaaggatgggttgtgattggatgacagagtaaaactgtcatcctcttacattaccagtgcatagtcttttttctcttagttatattagtgagttagttatttaagatagtttggttaaggcatttttcctataaataagaaggggtgttttgagggagggatatcttgtcattttgtaagaggataggggccaattgggcagtaggaggtgcagaccctcaaagttttgcaagtttaaacagttttctttcagtgattctttagtcattacaagaagctaccaaaatatacaaacaaaaaactcctttcaagagaatatgaaaataaacaacaagaaataaacaatcagtggagacagagattcagacaccaaccttttgaagatatgaaaagtgggccacttttaaaaacctgccaaatagtaacatctgttaggaaccacagggtagctccagactaaacctaattgaaatgaaacaagtgtaaccaaaatgcatgacagcccccaccccctccaaatccaagttgatcctttggtagatactaatagcgtcatatttaggaatagtagatatcaagattataattatttaagaacagtatatcttcttcaaatttgtcaactaccctatatttttttcctagtttttccacattttggcaatgtagttcagtaaacgggtgtcttaataggttttacttaatgggttaaattgctaaatatattttcttttcacttgactcacctgccaatctgttcggtatatactttcatcctccaaactgtaaaattccttattaaatttaacaaaagagtaaacaaataaagatgaaatctgaggtactaatctcagcctccaacatgccaccaactatcaatcacattgcccacataaatcccgttcattgccacataattataaatgcaaaaaaaaaaaaaaaaaaatctttaactaaactaacatgcactgaaaatattaattttattcaaaagaaaattaatcttatgactaaatttcagttaaccttacctaaattacaatgtgcattaactcgaaatcgattattttcaacaaaaaaaagtcaacaaaatatctgcccctccaaaacaaaacataccgtattagaagccccaggtctcggtcgctcaaaagccgctgaaggagcagacatttccacacaaacacagtatcactgaagaaccagcattgccactcacttcaaacccaaacaaaaccccatcaccccacaaaaaaaaaaaaaaaaaattaacctttcaacatttgaaaaccccacaaaaccaatcacagttccctattgagtcaacccatcagagagatccacaagtgagttccaaccccaacagccacaacaccaaaatcgctgagatctgactgaaaaacctcaaactttcagcacctagggttcaaaaatcccaactcgattgtatcctcacataagccacaacaagggcaagaccttgcccttctggggtttcaattttccgtcacttccttggcgattttttcgcactttttgaggcagattaggtgcgaggagcaagcaacagtggttgtgttgtggtggtgatgtgaaaaatctcaagagaagaaagggttctttgcttttcacctacttctggtgtcttctgagagtgtggaggtagagagagaatgaagggtagagagagaacgagggggagggaaggtaagggtattgtgtccgatatagtcaagtttaagtcttgtcaggtaactgtccaatgaaaatgagccacgtcagcaacataccagagttagtgcctgtaaattatgaatgttacctaaacacataaataatggtctcagatggatgataggattttggtttgggatggtgatgattctaattcaaattcattcacctccttaaattttttatgaactaccttataaaaaattaaaatcttcagatatcgatcacatcaaataaagttttagaaaaaaaatagtttacatttttagtttgaataaataatttatgcaatctaggtatagacaatcattttttttaggtgaaattctgatcttactaaaaaatcttgtttgatgagtaaccacttttcacagatcatttagtacccctatgaatcaaggaatcaaatgaaaaccgactttgggtaaaaattactgtttaaggctgcacgacttcattggtgtcctacatcgtgatattgagagagtatttctccattttgtcactttttactcaacaaaaactgaagaatatatactgagatattttcttctaataagtttatttattttcatacgtaaagctcaatctatattgtttaagaaattcaaattttatattctgctcaaactaacaattatataataagtttatcaacttttataataatttttttaaaattattattctaaaatttgaccaaaagtatataaagactgattaatattttttttccattaaattaactttaacttaggtgtattaaacactttatatctaataatttggttaaattattttagttttgagtttaaaattagtgtcaatttcattgattaggacaaaaatgattttaattttacgaatccgaagagttccagtggaaaaatagtttaagataatgtaggaaacaacttcctgttattccgtgattgcctcttctgttcagcacatgagccgcaaagctctatgatgaaacacctagaacatgctgtatcgcatgcttttctatttttttattagttttgtttaaaaggagaaaatctggtttatgatgaaatggatttgaacttgggtaatgcaatatatgttcttgtttatgatcaattcatgcaacaaagggatgttttgattctaacttataaaaggagtaattcttttgttgtaaaattaggaagttcaaaataactattattgtgacaactaaacaaattaaggaactaattaatgtatgaggttcaaatatactgtagtatcatgattaacagcatcaaccaatttaaattttagagtcacattaaagttaaaatacaaaaagaaatctgttcaaagcaaagataaaatgtttgcacgtgatgtctctttttttttaaagaaaaaaatatattaatagtaccaaaattgatttagtatttcaaaaatcaaagggggttattaattcacactcgaaaagtgtgagaatgcccagaggatgatgaacaatttattatcttatttcaactccttattgatagaaataattttgaacagtccaagtggatactcttttttccttcttttttaaatcaacatgccagtaacacattgttttttagaaaaaggaaaaagggatgaaaaagaaacagtacatagtcatgattatggctttgtattagagccatctaccattctttattttgtatttttctggtcttttcattatgaaagaagatgtcaaagttaaaatggtcattgaagcttagcttacactgcaacaaacccatcgcacatacatacatatatatatatataatataatgtttatagttattataatactaaaaataataaagagtgtgcaattgtgataagagcatttcattggtctttgtttgtctcatttcgcacttggcattgcctcgtgcggtggtagaaaataagaacatgggacagagttgttgagggggtgaccggttgggaaggtagccggtggaattgctgctctggacaatttgtctggttcgtttagaacaaggaaacgatgaatgaatgaggttacacttgctaggctttgtcttttgggtaccttttttcgtgtcaccacccaacccatcacattctcatgccatcatgtctcacggtggtccaaactcaaaattcactgccaatacaagcaaaccagattataaataagtttatatttcaatgttgcaatgaacttaaggcataatttagtaacacattcttgtactaaagaaaaaatagaatcaaatggttattccatttattatgtttagtgaatttgatatataagatgggtagaatgattgaaggaaaaagaaaagaggaaaagatcataagtttaatctccttttactaacaaaaattaacattctaacaattaatatttttggataaaaaaatagttaaattaaatttttagtctctcaacttttataaatttcaatttttaatcctttagaatttttatactacttttagtcctttatttattttctgttagtaattttagtctttctaaattttttgcatatttttaatcttttatttatttttattgttcataattaatttttattgtcaatttttagtcttttatttattttatatttgaaattactcttgagcaataaaaaaattagaaattaaaaatgaaaaaaagagagagaaactaaaagttatgatgaaaaattaaccgaatgactaaaaattattaaaatattttaagagatcataaattataatatgaaaaagttaagaattataaacttaattaaccaaaaaaaattatgctaagtgaattgtttgccccaacttagcatcgggctacgagtcaaagtggtaggaacgcgcaatgtcaaaaccatggcataaattagggagaggctaaaatggctaaaaagagcaaaaagaaaaaaaaaaaaaaagttaacatgagaaggagcatatgttaaaaaaacacacatagagggatctgtcaggtggtacacaccccactagtactttttgtacacaaggacagaacaatactagaggaatagccttataaaacatctttaaaaaaatataagaggagttctttataaatatcccattaacatttatatattttttttctatctctttctattatattatacttcttttattttaaaatgcctaatgtttaatatttttttacacagaccaataaaataaatatttcaagaaaattaatatttattaggagataattttattaaaatatcattattctttctcttaatttcaataaatattttattggatcttctaaaataacattatttattacatgacagaaatagatatttacatatttcattaaaaaataataacatcaatcaatttgaattttttttcaaagacttaaacattagttattttgaaatggaagaaatgctatctaaactaaatatcttttcagaaatattattgatcatgtatggtgctagaacttgataccttgtgcatacaagaagcacagtaatagttttgcctttgcccaactgaaagagatatatgtgcctgtcattccctggccacttttgtccttaaatcaaatttgtattttatttttaatttaaaattcttttcaaaaacttgttgatttctatctttcttatccaattttcagattgattatcattttttatttcctgacttagtattaattagagataaatatacttaataccaatggagtcctcattaattgtgtacgttgtcaagtacctagccatgcaaattggtttcctctaattaacttgctctttctcctctcagagttcccattttgattaattataaattgtaatgacttaagtttttggattatcatgattactgagaaatgtaaaaccttttttccaaatggcatgtcgtttttggaattaccataaatagtgatgacaaaacttaaattttttttttttgggtggtggtggtggtggttggggggggggggggggggggggggggaagaattgccacccccaccaatcttatgctccgccaccgatcatgtccctcctcgaaatgaatggtccccatactttagcataaaaacattattagaaaggaaataaacatagaaagatccaatacgcgttttaagtgcaaaacaagcataaacaggcctgcaattcataattctatatgacgtgattattctttttaataatcttatcacttcataccaagaaaattaattctttttaagaggattactaaataaagtgttttaagaagacatggtcatcatgtttttccgatgttatctaaacagattatatccaaaaactttgattccttagacggccattgtccaataaacaataatgccacttgaaactcacgccacatgtgacccatattgaaagaaatctttctcacaagggtggttgaggcagcaacgttcagtctgaaaaatcgcaaggatgaggagaagaacaatattgttaatttcaattatgaattactagttctgaaaagtcaaaaggtcacgtagtccttctttggtactacattgttatatacttgcatattgcatacttgcatatttcaattatggtttcctattttatcattcattggatactttcagctgcttgtcaccatgattacttggaaaccatcatggtaatcttatatatttgagtatttatgaaataagctatatatagttttcacgtaaaccgaagagaagatggtagatatttttgtttcttcctcccccggtcctacctttatcaaaatcattactcacaaaacaaaagaacattcttatttaagttttatcttcacattatgaaatgctatgtagtatttatcttggttagattactgaattctatataaaaaaaaatccaaggttcattaaatcgaattctccatcttgcaagttgcatacatggcttaccaaattcacttaaaaaaagagtttctataacctaagtatccatatgaattacatccccatatatatagtgtttctggtacgtattggatattatccacctttatacgtaaaatttaatttttctctgttgcacatgcttttgttgtgattgcatttgatgcatgaaaaataagtacaaacaaacctgtttctcactgacccaacagtatctcagtgagatatatatatatacaagaaatttttaattaatcaggaacatttcaaaatatagatgggaagaataccatgataactaaataaattataacgtacacatcagaataaataaattataacgtctaataaatgttcacgataacccatcacagtgtcttttaaaacatgagttctttatatttttatgctaattttatacaatttttttatgatgtgctatagctgtatccatatcgtgtcctacgaagtactatttatcttatccttatgtccgcatggtattgtattcatattctgcattcatggatttttttatacaaatgtcatgttgtgaaagatgcccttaggtaaaaatgccacagacgtacatgtacgtacttcaattaagggccatagaaaattcaatcatattcattttatgaagaggaatcacagtgtttgctccagaatctgttgatgaatggaagatatagcattagacagattgatgagggatttaaagctagtagatactgaagaaagagtgggaatatgattatttgagaagtagcttgaacaagtaacttttaagtcttaatgttatgtggcctatttcctgaaaatcataaaatcagtgaggaaaatttagtcaggcatgcagtggggttggacttatgttggcaagttaatgttgagtaattggacatagtgtgaatgtggagataaaggagctaatagaatcttgtcttctaatgctctgtaaggaaggacaataccatgtgaagatgcctaatatggttcatgatggggtgtgcaatcaaggtaaatgtcgcaaaaaaatctagatgcaaaaagggaagttttatattttcaaggacaatatcaactttcctcaccaattggatgctcctaaacttcatataataatgtcaatacatactgaaagtacctttggaagatgcatcaaattgtggttgtaatttctgaaaattattgagtacttttgccatcactgccacaatcatgtgaaagtatcatccctgaaatgtttaaagccattagaggcatggatgagttaactgtcctttctctaagccattgttaatagtcctagccctttttgctcaagatttttgaaccagcaagatgaaaactcaatatatgacaatatatggaaaaagagaagtgctctataagaagataagtgattaggtatagttgaattcagtaagaaacctattcacatgtgagggagagcaaatgtcctttcttgcctctcacttcaccaaaattcacaagcaagccttataagtttttatattttgtctcttactcctataattttgaatccactggatccaaactcaactatatttgagttttagttttcttggggggataggggttaatatttctacttaagcccaataaatttataaagttgattttttttttgtctttattgacataaacaaacttaaaacctagtacctactaaatttaaactttcatcatttttataaaaagtatcatatttgtctacttcttagtatttccagtaattaaataaccataacatatttggagataagagcgagagtaatacgtttaaattttaaaatatgtaaattattttattatatatgtgtttgttaaaaatttatacaattgtaatatttatcaattcatcttcaataacaatgttattttggctattgttatatccactctccttttccatttttttttaatcaagttacttaaataatttttccttttcaaatcttcttccctctctttcactcccttttttcttggtttcttggtctatcataaaggttttcttatcctccaaatttcaatttagtatatttacactctctaccactttactttcttgttttatttttgtctactcacacaacattattaatgtctctcattttatatatgcagcaatatataactagatcttaaatttatcgaaattgttcagattgagctatggatatcaattaatatgctttatccacttcaattttttcactattatacattttttatatttatatagggtttttaatgatcctagtattttgcttcaattttttctaattgttttttttacattccataaagtaatctttggaacataaaacaatattattgaaagtacttttcataacacagttttatttttattctgaaaaatactttcctaaacacaaaaacagtattatggaaaatactttatgaaatgttaaaaataaaattttgttctaaaaatattttttcataatgttaaaacaaaacatattgttttaaaaagtactttttgtaatagtggttatgcatgaacattatggatataaagagtacttagcaaaataatgggagtggatttagcaaaggccttttttatgtaaaaaataaaaaggttgtcctaaagctttgaatccaccaccaagtttcatttgtgatagttgatttttcacttttttcgccccgaatgaaaagtcttcacaccgtattgctccggaatctagttggtctccatggttaagttactgaaaaatttaaagacattatcgaagtttcgaactttacaaatttttgcaagaaaaaaaaatagatttctactataataaggattcatctatgtgaaaattaacggaaggaaacacacaaaaaaaaaattaagagaacaataagtgtaaaatgatgagatgtagaattattgcgtgaaaaaaatgttatcaaaattgtatttataaatattcacaaaatgagttgtttggagattttaattttaatcgttggaattatcaagctttatcattctggagcccttagaatgaaaacaattatctctttaccatctttatttttttttcagcaaaagggggaagaaatactactaagattaattaggttccactaaaattcagaagagctgaagaggcaaacaaatacagaataccaattctaaaattatcattaataattatttcgaaaaaaaagttccaccaagtataagcaaaaggtaaattttcactaacagtcatagtgcttaaataaacagaccatgaaatgcaatgctccaaataactttataaaacatccttaatgcttacatctagtgatagatctaggatcttagtaaggggcattttttttttttaaaataattaatatatattatgaaataggtaaaaaattatgaacagaggatcaaatacacaagattggagggtaaaatctacacactcaatatatttatatgtgattttaaaaaaataaggaaatgaatttgcacctctcattataatgtggatccaccactgcctacatcagtttgttttgagcattaccgcatcctatgtcatgatcttgttgttggtcctggggtacaagatcctcacttcttggatgctatgggaggaggaacttcattgagattgcaaaatataaccaaatttgatgacacaataaatgaaaatcccacccaaaatgataaaccaaaaacattagtgttattaatccatgaaaagaatatgggagcaaacgagttaaagtctgtttggatgtaaagttatgagtgtttttgaaagtttttctactggaaaaaaactttatattttcagtcgaaaaactctcaaaaacacttgtgattgtatccaagagactcttagtcctgcaagctggaggtacatgacagcaaatgcagcataggaaaaaataagataaggatcttgttttcctttctaagatatgatcacattgaatatattgttttgaccaatgaacattataaaataatttaagacaacaattattttgggatggagggaataatatatacttggctagctagtaattagtatttaccaaaaaataaagatgtttggtagtggaccaatgcttagaatatagatggaacttacactggcttaaggtagttgtaagttgtaacagtgctatgaagatttgaaatttagagggatgttgtataggttgtaggtggagatgagtggtgtgatattgatgagaacacaacaaaagagagaatattttaattggatacatcaatttctaataccactacacattacatagatagaagatagaagagtgatgatggagaagagggcgatggggagtacaaggacgaagggaggggtctttggattagggatggcaaaacgggcttggtccgccgggccggccagcttagcccgcaaaaaaatgcgggctgggttgataatatcaacccgcaaatcaaaagcgggccgggctggcccgccctgcaaaattgcgggccaaacccggggcgggacgggccagcccgctgggcctatattatttaaatattaaaattaaataaatatatttaacatattttgaaataggtatattcttttaatttatactcttttgcactctcatgattaacttctaagttttaatattaaaatggttatgataatgatactttcaaatagtctttcattactagcatattatacttttgaacagtttataaccgtaaatttcatttgcaaatggtataattttgtgaattatcacataacatcatttatttagcattaattttaaattatttacttttatttaactttgtattttttttaattatcatatttgtatttttttataatttttttgtattttattttttaaattgacttttttattttttttaaatttttgatgcgggctggcctgctagcccgctggcttgcattaaagcgaggcgggctagcatttgtaacccactttgcaaaagcgggccgggccagcccgtcccgtatttttcgtggatcgggccaacccgccccatttttttgcgggccggcccatttgccatccctactttggatactcttatcatataatgtgaggggtttgggggagggatcaagtgggagtatgttaagaaaataaataaaagtaacagttgtttccataattatattaacaaaaaagttaaaatttccgttttaaaaatacatattaacttttaaatatatatttaacttgttagcttaaattgtgcatgacaatcactatttatataaaaaaattataaattaattatatttgaatacgaataagaattaatacctctatcaatcaatcactgtcttaaagatataattatgaattgaaaattaattatatattaatgatttaaactcgagactaatattatttaaaatagaacgattcagtatcaatttatctatgtattgaatagtattttatgtcattgtaatattgataaaaaaaaaaaagtaaattaaaggcaatataaaaaaaggtagatcagtttggtgactttggtctactatataaaccagatgtgaatccacacaagaaattacaaaacacacacacttaataaaaagtaaatgggataactctataattgtcataacgttaaattaacaatttcgaatagtaaattgtaattgcgggggaacattttttggtttttagaaaggcggtaaaatccaaagtcaataattaaattccaatcataaagcagaaggtggcgagtggttgtaagaggaaaaagtcaagaagaaagtgacagtggatgaacacaagagaaagaagaagaagaaaagggttttgtgtgtgtcgaagtagatcgttccttccttcaattaatctccgatccgaaaccgaatggggattctatacgcgctggtaggtcgcggatcggtggtgctggcggagttcagcggcaccaccaccaacgccagcgcaattgcgcgtcaaattctcgagaaaattcccggcaacaacgacatgcacgtttcttactctcaggatcgctacatcttccacgtcaaacgcaccgatggactcaccgttctctgcatggccgacgataccgccggcagtgcgttttcccgatccgttcaattctaaacctaaatccctaatttattcgtttttaacattttgaatttgtttttttttttctgtagggagaattccttttgcgtttctcgaggacattcatcagaagttcgtgcggacttacggacgcgccgttcactccgctcagccttacggaatgaacgaggagttctctagggttttgagtcagcaaatggagtattactccagtgatcctaacgctgataggatcaatcgtctcaaaggtgaaatgtctcaggtatcgtatcgttttttttctctctctcttcgattttatgcagtaattgaaaattgagaactaattgtgctggtgagtgtgtggttgaacaatcctagattcctagcaatggtaagaattaataagttaataactagtagaattgcatttaattcaacttcagttcttttcttcctttttcagctattcaaacactgcgtaagtccaatgaacaagataattgttccttagaaatgtaatatagacattaaatttgtgattaacgggacaaatacatctaataatgactaatgagaagcatttctatttgatatacactttgaattttacattttatactcaggtcttgtttggataggcttctatataaacacttatacgagaagaaatagagaaataaaataaatcaaacttctcctgtaagttaaaatctagtcatgcactttagcttttagagaagttattatatgagagcttttaaaagttaagctgtatcagactataagttcattttaacttgtgacttgtgagagaagcttgatttattttacctctttattttcttttctcataagtgtttgttaagaagtttatctgaattgggccttatgtttatttgattcacttcgtttttctgatctcatgtgtgttttcttttcttttgggttctttaacaggtacggaatgtcatgatagaaaatattgacaaagttttagatagaggtgatcggttggaattgctggtggataaaactgctaatatgcaaggaaacacatttcgcttcaggaaacaagctcgtcgtttcagaagcactgtctggtggagaaatgtcaagctttcgtatgttcttgatctaaacctcagtcttattagttgaacttataaggaaaaaaatgcagtctctagaatgaatctgaaaccttttctccatcctttttatattatttcttgcattatcaactggatgttcataaatggaatatttgtcaatatccttaaaatcatctagagtaaaattttagatatttgataggattctgatggaaaccagctgggcttaaacttaggtggttggatgtgtggggattaaggtagaggttctggtttggaacttgaagtgttggtagaaacttcccaaggtgccaaaacatttttcttgatagaaataattccactgttaatttttttcttataattataaaagaagaaaaattatcagagaatggaagagtagaagaggtagaagtgaaaaaggttgggggataagaaatccttggcaaagacaaaagaggagaaaaaacagagaaaaaatgaatgctcctaaaaactagtcaatgtaggagagttgtgcagtcttgttgaggtgaggaacacccttgaagatgtgggcattcttatcaaaccacaaattcccataaacagtgcattgccacaacatttttattttccttcttattaccaaacccttcaacttcaatgtatagaaactgatccagtgaactagaacacacccatacctgagtaatggagaaataaatgagacagtttcaaacttagatctagcctctgctttggtgttggaaaatcatgtcctgcactttctaacaaaaacacgtgtcccaatataactctatggtcataaatttggacatattctaatcatgctcaatggttcaaaattaattttatcaaaatcaattgtacacgtgtcattagtattaataaatgtaagcatgtgttgtgagagttcaattaagtaaaatttgaattatctctactagttttatttttagaattatttcaaaatagtaggcaacaaacttgtttccttcatacaacttcataatactattaatcaatctttagctatagttatgctcattttttttggtcttactgactaaatggttgcatgttgcaggattgcacttatagtcgtcctacttgtgatagtttatgttgtattggcttttgtttgtcatgggcctgcgctgccatcttgtttttaagtgaaggattggcaagtgaattttatgtgtgcttccttgtcttcttcagcttgcagaggtcacttctttttcatctgcctttgttatgcagacttccatttcttcaacttaaattgctgggttgtccacttttgtgctagtaaatttcttgcaatagattcaagtgttttgggttgtatttttcattacaaggcttgaggggcaaaacattttttgtatcatgttatatattgtattctcctaccagcccaaagatttggattgaaccagaaaatgactgagattataattgatgtatagtgttgcagcttgaggttgtcaacgtgtcatggatgttctcttgttcaagagggggaagggtaaaccttaaattccatgtgccccttcatagcttagtgaagggggatttttaaactgctcggtccggttctcttgtccaattgatgcgtgtgagccacatatgcttattgtatattttcttaaatttatctttgtctgttttaaccttccttttatgtgtcaagtgtgaactgtgaagtatgaaggttcgtgactttatttcttttcgcgttggtgattctgaaacggtccaaagaaaagtgattgtgatgcaagagacctatttcattataatcagcaacaacgtttctgataatctggtctatggatttagtaatttatgtcttttttgtcttcgtattgcaacttgcaagttagtttaacttaattttgaggaaataattcctttttcaaaagttattacacaatataacataatattaaaacaagttgaaccaaacatttacattatgacttgttgcacctgctctacttgtgacatcccttgtaattcgcttttagttatagtgtttaggatggtcatcgacaggtaacattatgctaatgctagcccatttctttttcctaaccatctaagcccattcccatagaactagtagttcagtatttgatctgaaaaagtattgtgattgttgttgttagatttcctgttaaaacttaaatgattgtaatccttacttaaggtcattctttttctttttacacaataaattccctttatcttgtgtgaattgtgattgttgttctgtttgacttgcttccaatatatgttactggtcttcacatgttacaagcaagagactgtctgtatgtattgtgcattatttccatgaaaataaaggtaaaaatgtaacgacaaaaaaaaggctttttttttttgtaaatttgagaaattaaaaagtgtaaattttaatttgaggactaaaacagacttcctcaaatttgaggattaaaaacatatttaaggatccgacttgtgcaagaaaatgactgcctgattatattactttgcatgatactgttatgtcaatcacttgcattagttattaaacttgtataattgaacagaagactcttgtgctcaacaaaattactataatactaaaaaactaaaaaaataattcaaagggtggcctaactattaatacataatcaattgaatgaaaatatatattgtctttataattgtaactcagctgctgactaaatttctgtcgctgcaaaagaaaacatagcgagtgtataaatttccgtcgctgataaagaaatatttctctaatacatacgactgaagtatatttggtttatttgacaaattaattttcaaattaaatttgtcattatttgcaactgaaatatattcggtcactaattgatgaataaaaggccatttgcgactgattatttattggttgctaaatgacattttcttgttgtgagtattttttttgaagagaaaaaaagtttaattacttcccgttgaaaagaaatagaagtggcaaatgtaagtaagaagcctgatattgagtgttgataaacatattgagtaatatattgttggaccttttccttttcaagtgatcttatgcctattttagtttcaaaataaagtaaaaaaaaaggttacgcacttacattattgtgcccttatcattataacttagaaaaatctacatatttaatgctttaatatttttaaaaatacctaagttccttcattaaatgtcaatcccttgcacatttaacaaaaaaaaaattgttttaagctcaatgacccaaattacccctcatccttttcctaacttcgagatttaatgagcattttatcacaattcaagataaagaaagtattttccaatagaaatctcatccaagaatcaagctatgcttaccaattcataataaacatgaaaaataaaaataaaaagctaacgttgaagaaaaaataaatatataacactattttaaaagaaataaatgagaacataaggttcatatacaatctaatcccatcaatggaggacttaactacccatctccatgaataacacccaaaagcaagaaagatgaaagaacaatggaaaaagagagttggagaagaagaactttagtaaaggaggtgttttaatacaatgacgaagcgtcccttaaaaaagaaagaatctatttatatagacccaaaaaatctctacttaagtgagtgtctgcccaagtcaaaaatttcgaatttaaacatatattacaatttgcacctctgtccaaattcagcttaaactaaaagttattttgctgaagctaatttttctctgtaactttctttttgatcttctcaaaaaaggaacttcgatttggatcctcaacccaaattaagcacatttgagttgaaagttttatttcaagctttcattaaaccttgctcaaaaaatgcaattcaatccaattcaatgtcctacaaaatagtccattaataaacatatgcaatctagtaaaataacaagttaaagagaaatttaacaatttacatccaaaaaacataaacaaagtcctaaataagagaaaagataagataattgcctaaattcagatgtcttagttaggtatttttggcaattataagaagtcttacattgaatgaaaaaaaaaacgttttttttaaagaaatatatttattgcatttcattcaaaacaacatcaaagatacaattggaaatatgcttaaagacatgattgctaacatgaaacttagatgccttaataggggaattgacaacttaatttacttgtctcgtaattaaactcaatctaaaattttaaaatgaatatattgaataacacgtaagtgagaagaactcaaaaaatttaatgttttaaaattttgaattaaatctaatgtacaattcatatgatttatttattatcatgaaatctataaaatgttgacaattgttaaatacttaaatgtagttttcttattattacatgtaaatccttccctggagatgtatcgtcaaaagctttctttatgttttggtgaataaaatataaactttatattatttatactttttatatttttcatatcttttttggtcacgttaattcttttatttcacatttttaatctctctttgatgtgtgaaaaaatgataaattaattactacaatataaatatagtttgtcaaaatataaatattttttcttaagtaaagtatctcgtatcggtattcctttatttgttagaaaaaatcccttcacagaaagcttttttcttttttctgaaaaagtgcacagaaagctttttctgatgcacaaaagatctcccttcatcggagaattttcctgcgcacgcggtgcgatatgttttaaaataaaagtaggattgaaatcagtttttcatattaaaaaatagatcattttaatattattacttattttttttttcaaacaactaattgaatttttttttatgtttgaacttaatacttatgattagtcttatctcgataaatgataacatgtagtatcatattatcaaatctaataattgatacattattaccataccatcatctttaataacgtgttagtaattaaattttatgacatgatatttcatttatcacattattatgtaatagaatgagattaacaataaatactaaattgaaataatttttttccaaatcattatttgacaaaaaaaatgaatttttagatactaatataaaaataacctaattttccatatataaaaaacatggaataactctcttttctatagtatattaataatgataagaaagagggaatgcataattaagagatatgatagtaactgtttgcaacgtggcagttgacgataaccatccctttggtatcattcaagaagacgatctttctttgagtagagttcattgcatttccaccagtgaagaagaagtcaatttgaaattggaatcccttttcatcggcataatctttcaacacaaaaatcaaacggtgcataacaataaataattgcccgtgtggcaactgaaaacaacaaaacaaaccattaccaaaaagaatatggtattaataccactgtcaaattttgaatataaaattctcaagaacacaaaatactcacgaaacagtttttaaaaatgaaaggtatgattgcaaagttctttgcactttctcctccactagataagtgttgaagttgattataactctgttaggatatgaggctagaattgtttttgagagtatttttactaaaaaaaaatactatatttttaatagaaaaattctcaaaaacactccttactcgtatccaagcaggccctacgagactctcaacagaaatggaaacatctttgaaaaaggaaaatatttataaatatataatatagaaataggtagattaaaatagtatttgtggttgatattataaggtaaagaaacattgatgcgatgtagcaataattaaatcatatgcaaggtagtgttgtcgcagacattacaaacttcaaattccttagtaacaaatgatgttcttctattgattcctcaatttctccgactcaaaacttagtttcgtgtttgtgatctctgaattatattatatcgatttgtgaattgtttttccacaaaaaaattcattcaaaccatggcttcattatgccggcggttatccgccgccgcaccggccggtcactttcagttccatcggcccgccgggaattgcgcggttcgatacggttattccgtccgccggccaatgcggttggttgcggcggggaccaccgtgggctgcggcgggtgggtgacatccgacgtcggagggagggaggagaaggtggggccctgctcctacgccatggaggatcggagggtggcggaagatggcggaagcgatgcggtagtaggaagtaggaaccgggtggttgaagtggcggcggcggcggttgcaacggtggtgctgggtgttgggaaccgggttctgtataagttggctttggttccgttgaagcagtaccctttcttccttgctcaacttgccactttcgggtaaagtcaaaagacaaagatagtagaatttaactgaattacgttaaggttctaactgtctttttttttttttattcgttagaataaagattacgccatggacttgcaataaattaagtactcttgtttaactaattaactaattcgactagatccgaacaactgtcatataatataattatagtatatatttacttttattataagtaatttaaaagtataatttagggtattttttatagtatactatttcagttacaattcagttcaaaatattattttacttaaaaataattaccacatacatcctgacatgtattaaattgttaaaaataaaaaatgtatgaaaaaagaatatatgcaatatcagtataaatgtgttttatattataatctaataatatatatatatatatatatatatatatgataaatttattatttttataataaatgtgtatatcttttaaactcaaaatgtattttttaggaacttaaaatttatattgaataattgaaatgtgcattttgttattttttatgctaaatttgccgggttgtccttatgcttgtggacctagacccgttaaaatcatcacatggttttgtgataacttttgtgcactcctcgtgtccaagaattgtttccttttaaggtgattttgtggtcaaatgttgatttgggtgattgtgaggccatttattttaatgtttacaaaattgattttgacagaattaattttgaactgttacacaacttaatataaatgtatatataaattaatctcaatatcaaaaaagtaggcagcaagaaagagaattgattttgaaacatgcatcaccatacaattaagcataaaatcgattgatgttgcttatttgatttcagatatgtaatagtgtactttgcgattttgtatattcgacaccatgcgggcattgttactgatgagatgttagatgctccaaaggctccatttatagttgttggtctattggaggctcttgctgctgccactggaatggccgcaggaggtaactttgcacactttgaatcacattttcaactcattctaatttcttccatcagcacatcaagtttgttttgttttgtgatgatgcactgatattcatactatatagactatagtaggccattaatggaattttattggtgttagtttgcttcatagaatagttggcagaaaggcctccctaatgttcattagatttagagtggagtgtgtatactcagattgcaactgtgcaactgattaaagaatatctcatagatgtaaatattgctatatgttgactaaaatactcttttttagtatcccattatttgtaataaattgttacagtctctacaatgcttatacttccagtgttgacaatatacagcataaagacttggactgctatagttggagatgctaagaatatatattatcttttagttgtataattttatttctccacgaaaatggtcacattctgaattgatcatctattgtgctctttcttgtatcagcaattctctctggagcatcgattccaattttatctcaggtaaaaccaatcagcagtcaattgctctctggcatatattcttaattcctgttactgttgcatctggtgattgttctataggatgacaatctgtgtttagctcatatatttacaacttgtgcatgtgtttagtaaaatgtaaaataaagctagataattaatttgagctatcctcttgcagacttttctagtgtggcaaatactcctgtcaattatttttcttgggagaagatataaagtcaaccaattacttggatgctttcttgtaaccattggtgtagttgttactgtagcaaggtcagtagtacatctaattttattaaggatcttagaccatggtgactcaggttatgagtgtcaaaaagggagcattgttgaaccatgataccatgatacaagtaatgaacatggtctacaaacaatgttgtcaacaaactaactctgaaaagtctaagcatcttgacacaattattattaaaggttgtcaagcaaattgatttaatgatactattaggtttgttctataaactcagaagtctaagaaattgttgcttgttggtaaaaaactgctttgttattgaaatctaacataatgctttcaaatgttaattacatctttcatgctgcacaacaacatcaaaattcttggactgacagaattttctcccaaggcatgttgaataaagtatgtctggtacaagctatatgaaaattgtggttactttctatggccttcttatttatacatttgtttactattgtagtggagctggtgctgggaattcattaaaggaaggtggtatgttttggagtcttttgatgatagtttcatttttcctccaagcggctgataccgtgctgaaggttatcatggtttataatgtttgttgcattttcccaaccttcaaactatttctctatagtttacactgtccttttcatactttgcaggaaataatctttttggattcatcccgaaaactgaaggttcgcacaatagtgacttgttttaattcatgtttatgctaattatggctttgaatgatcttattgggccatttgacaacctgaattatgcaataacactacttttgcactcacaagcacatgcgcctcaaactataatgcagagaacaacattactaaattgtagtatatgtaaaactttcactttagtgatacatgatggactcattttaatacccaacctaaactttgcattattctattgtgcgagactctaaagcttccaaaccacaattttcagatgcatgttgctaaactagtcctatttaaacctgaaatttcttttcctgacatgaatatactaatcaatattcaatattatctgaaatagggaggctgttgtatggacctttttgttgtcaattcgtacggatctgctttccaagtaggtagcctgcaatcttcaatgaaatgttcatcttttggattacaatgaagtgtttactatataaatgcaaataaaggtctaaatgcaagaatatatgcttagtgtaggccctattcgtgtgccttcttctccccttcttgtcaaaattatggggcattcccttcagtcaactaccaaactaccttaaagatggtgcagcctgcttcctaaatgttggtacattatcaagtggtaagctatatttccttttcatattgtcatatcttatagtggtaagtttggtgtccacttaaaaatgagagtgaaaatttcaggaatgagctatgaaaaaattgtatgaaaagtcattcctaaatatttcactcccaattttaagcacgttaccatactggcaagattacctagatcatctgtctcttacatagtcatgtcacaaggcaagattacctgcatgtaaaatttctagaagaattgcaattatctgtttgatgagttgacttaaaattctcattttctattcttattctaatggtaattgaaatgaaagaaactgatttattgttccaggatgtgatggtgcccctctgcttcctctgctgtttattattgtaaacataggtttcaatattgcattgcttcatctcctcaagatctcttcagctgttgtatcttgtcttgcttccacattttcaggtatgctaattgtttcaccaagcataactatattgaagtttatattggtgaaattactgtatgttactcgaccaacacatgttagtggtcatattctagaaagttaataaaattcgcgtacatattacgtgaagattgatcagaaacatggaaacgttctagtttggaaccgtataataatttctcgtttatatggacatcttgctctaaaatttgtgaaaacaagggagggaagttatgatgaagtatgcttaaatatatttttggttcccaaatttaggtcaccgttggttttggtcccttaaaatttaaatttatttatttttgtcactcaatattgaaaaattatgagacatacccaactaatgcaatttggcttgtggcagtcccaatatccatctacgtgttcaccatgccattgccataccttggtgttgcctcctctcttccaacaggctttatggcaggggccattatcctcattttgggcttactcatttatgcttggaccccttcaaatggttcctcgggtgcttccttctcaacttccacctagagaggctagaatgagttgacatgtcattgcagatagtacaacaccacaaggaactaattcaggttcacttttaggagatggctattagaaggagaaaggaatagtttgttcttgtaagttgtaatagttgttggtaagcatttttatgagctaagctcaagtaagaaagagactagactatagatagaacaggtcccaagttcaatttttgtgtaagctaaggaaaaaagtaaatacagaataaaagtcattttgctgactgaggtctgaggaaatgatattggaccatttggatgcaacatgttgttgaccactaagtaaataagtgattgagtatatacaatttggtaaaaagcactagtacaaattgttgaccatttggaccatttgtcatattttttttttttgccaaaattcaaagtagtactagtagaactttttctttgaggaataactggtagaacttaattctcataagataaatttaaacgagtaataatagttatacataaaaaatataatgacctaaaaaaatataatagaaaactgtatcaaaattcaataatactttttagcactgtaatttttattttatttttttataaaaaaattgttttagtcgttctacccaattgttttttgttcaaattatttcacaatgaatactttgcaaagaaaacatatgtgatgcggagttggataataagaatgcaaaattagaatgagttatcgtgtaaatgactactaattcattagtcatgtaagtgaaatctgtgatggtatttggaatgaggagggactaaaactttcctcaaattaaagaattaaaaaatcaattttaaatttgaggggaaaaaataaatttactttaaatttgagagattaaaacatatttaagtgaataaaaaaagacgaaggattaataataacttaaatatatttttaatcatcaaattcaaatatttttggtttttttcttaaatttaaatttttagtcctcaatttcaaaaaatactctttttaatcttctccataaaaattaaacatcccagtagtaatccaaaatcaatttaagatttttttttaataacgaggaactaaagaacattttttgaagttgaggtactaaaacaaattaaatttacggaaaaaagaaaaaaaaccctaatttgaaggaaaataataataagattatgttgggtaaaattaactaactagaaaatgagttgacggctcaaaaattagttggtagctaaaaaattaatttattaaattgttagtgttcgataaaattaattattagtgtagaatgacaaaaaataattaaataattatttatttaaaaatgataactaaaaaattaaataaataaattaaaaataaaaatgaaaaaaaataaaagttaaaagttaatgttttaaaaaatattattttaaatagtgtttcaaaaaatgttagaatttattaaaaaaacttatttatcaaacattcaaatttttaactagtaaaataaactaaaaactaactaaaatcataacttaaataatccattaataattaatatgattaataatacaaagtgataagaaaatagaaaaaatatcaaattaagcatttgactatttacatgtccatagcatttatttgacgtggagatataaagttaattgggctcttaaaaaagaaagaaaggagaaaaatgtttttaatccattctggtaaaaaactttaataaattaataactaatatttgtgaaattttgctctccatataattagactcttgaggtgtttatataatgaatatgtgaaaccaatgtgtgtattttttcggccagacaaatagcaaatagcaataatagcagcaatgtcaatgttgcgatcagtttgtcagttaagagtgggagtggcaactccaaaaccttgcttccatccctcaatcttcttatcctccgtttctctctctcacaacactcacacacacacctctttccccagaaccttccgtttccacccactttcactccctctttcaccctttgtggtcttcatgcctcccaaagcaacaggtcctcattctgtgcaaacccccttaatgcttctgtttctgaattttgtttctgattgcaatatattatgtatcatcactttattgtaagatggcaaacaaaattttcataaaaagatgcaattttcattaaaaaaatgtttttccagcttcctatggcactggggctagtggtgctctgcaaaccccttaaatgcttcttgtgaattttgtttctgatagcattagattatgtatcatcactttttttgtaagatggtaaaaagaatttcataaaaagatgtaatttttcattaaaaaattctgtcttttcagcttcgtatggcactggggctagtggtgctgctgaaggtgataggccaagggagatattggtgcagcatttgttggtcaaagaagatgaccagaagcttctgttgtatcttcagcagagaatctcttcaggttaaagacaccgagggaattcagttctttttctcctgccaatgtgtggggttaggtttcggaagatatttatttatttatttcaagtttatcattctaagaatctgttgttgtgtgtgcaggtgaagatttgagtgatcttgctgtggaatattcactgtgcccatccaaagaagaaggagggatgcttgggtgggtcagaaagggacaaatggtatgcttttaagattagattaaaccttgttttaggctttactttgcaactttttgaaggcggttttgcctgtttcagatggtattcatcactgccttgtgtaaatgaatctgtctttatctgttagaggaaaatatacagttactgtgaactttctttgggtaggtgagagaagggacaaattagatattatgctttttcttgcatttcacttaactgacgttaattttgtggtatgattctgtagaggaagcagatgaggtagtgatctggttacagaactagaagtgctgtcccccccccttctcccccttaattttactgcaacagtacaattatgtgattgattgaaaatatgtctgatggtgaaaatgtgataggttcctgaatttgaagaggctgcctttactgcacctttaaacaaagttgtaaggtgcaaaacgaaatttggatggcacctgctgcaggttttatctgaaaggtatttccaggcttatgtttctgaattggatgatctaatttgtttaatttcaatgaaaaattattgaatttttggcttttgatagagcctaatggtgtttttttgacccaattagccaacactacctagtgagataatatttggtgattgttgttgttaattccaacatgtgttcttatggcttgtaaatttgctcctttacctgatagggaagaatcaattcttcaagacattcaacctgatgagctgcatgtgaaaattcaagatcccagctttttggacgaggcacaattaattgatgtgcgagagcctgatgaagtgtatgctcatattttcttcaaccataattagttttgaaatgaattattgtttgatcgcatttggttaaatgtttgtaaatagaccaagtgagtgattataagctgatatgatttgcaatgagcttaaaaaaaagtgaaaataagatatatagttcgattgaaagtttgagagcatttcaattttcaatgtttatgcacttttgacatctcaaaggcaacaaggggatctacttttatttgactggttgggatattcatttagtagctcttacacttatttgcatctatttttcttttgttctgcagtttttggaatcttcctaggtttcttatttttattttagtagctgatctgttttttcttcatttaaattacattctcaacatgcacagggccaaagcatctttgccaggatttactgttcttcccctccgacaatttggaagctgggggcctgaaataactacaaaatttgaccctcaaaaggatacatatgtcatggtaagtgcagtttttcttctaaaagatgtcatttctattagaaggtatccaggaaactagaccactaatgcttattgattactgttctctaaattgattgagtatatatctttattgttcttgtctgaaagatctgttcatgttgctagtctcctcctgctcctcctttaatggtttagaggttgtatgttgatcaatattgaaactggaattctttgaataggttcctgcctttgcagtccaagtttgaatttttagaggcctttctttcgagatatttaataaagcaataattttgaattttaaattcattcatctttcttgtcagaatagtttactatttaatattttagtctgtctgaccgctcagttaacttgttgctgcaatgcacaaaatgattaaatttgggtctgatttagcaatgttttttcttttgtgtgtctgtgcattcaatatcttgacttctgaatgcagtgtcatcatggcatgcggtcattacaagttgccaagtggttgcagtcacaggtatttttttttttcccactttttgtcaggccttcaagttcaagtgtgtgtatgtgtgttttgcctcatcatttgtttacttcctgatatcacaatgcaacttccaagccatgcagacaattattgttatactgtaaaattgtatgacttttagacatgttacatgcgattgttgcttacaagatatagatgctttagactgtagacaactaatggataaacagtttcaactttcaacttgatcaaagaaaatctcatgatggtttttgatacctattgttcaccaattttcgtatatggaagtggatttgaccaacttaggaattaattctcatttttcactagttgtagtaaagtggttattgtttgtactttgtaatttaatgattggtgaacttttcagggttttaggaaattatacaatctttctgggggaatccatgcctatgctgtccaggttgatccatcagtccccacatattgatttacattattctgccataaatgtagtcctttacttttccactttccatctttgtacatgagagcaagattttgtgggatgtccatgttacctttaggaattggatttctcttggtatgaacatgtatttactttggatcaagagtaagaggctacatatcaagtgctagtttttgtgaagctggccttggctgtgaggtgatttatgattttcttagcaagtaattgctacttggttttatcgtttttttttttttttttttttaccaagggatctaactcaagttgttttgagcaagtgcacaagttgttttgatttctacagataaaaaatagaaaaatataaactgttttttgtgaccaaattttcaaagtgataaacaaatattttcttgttgataaaaagctttgtttttttcattcgtaaaattttgaacattattggttggctttagaaaagagagaattccaattagagagatgaagagataagtctagattaaaattcattataattctacaagttcaattttctcatgttattttcttgattaagttagttttttccctctaatttatttgaggttcaatttgattttttttagaattcaatttgatcttttaatttttaaaaccaattcaattttaaccttttgtcacgtaccattctcttgcaactaaatgcacaacctcaacatagagaggttcataacacagcttgagttaaaaaagaaaagaagaaccatatataaaaagctgtgtcaaaatgcttagaacgtggaatcaaactttgtaaagtaccaatggatcaatttccttcgattttattaggaatataatatttgcatttttgctgagtatacaaaaaagaactttttgtaaataaagatgaggaaaatagaatacaaattcattcattttttgttacctggaagactaatttcattatgtaacaaaaagactaatttcattagtttaagagagaaaggtgaatttgcttaatatttgacaaaaatatctatggaaaatctgtttttctcaacctttttttgagttttgctaagtaatttccaaatctttaaattttctttctctctcacttcctgatctcgcagtttgctgattgtttatacactgcgtaatcctccctattcaacatgcttccgacaaattacagcttttgtaattattatgagaaatttcgggtaaaggatttggtattattgatgaatgatacgacatccaaaacaaatagagagagaacatgtatgagaacataagtatctgattttgaattaaattcgtcaggattatagattatttttagataccgattattttaaactaaaaagaattgaaaagaataagccacgtcgcggcaaataatctaatcattaagagcttatggtatgagaccaccacagatgaaattgtttcaaatagacagtactgaaataatcttatttattaaaaataactagcaaattatcataagtttccttcctcaatttaactaaacacttccaattttcaacataagttattatataacaatataagttcaaataagcttcttaagaacttttaacaaagtcatataatatttttaacaagatattacattatgagtttcatcacttatatgaatatttttaatgaaggtaataagattaaaccaatattggagcgactaataatacatgacttcgaattattcttacttattttttctacaacacattctttttttctatcactttccatcatactatttatcttatgacatatttctcttcttatgtataaaaattgttaacaagggaaatacaaatcataagtagcatagttgtattgactcaaattgaaaagaagatattcaagactattgctcatcagacacgtttagagttagcaaattttcgctacaaaaacaaaaactattagtatgcgatgttagtaacaacttgcaaaatctttgaactgagttgttccagatcctttgacctgtaataatagaccaacaaaatccatttttattcccctctccgaaaactcctctccacccttgtcctaataaaactcttaaccttccaaagcaagagactcgccaaagactctttccaatttcttcaatctttccaattaatgcctccctctaatattcttcacaaccctttttaacaccctttcaaatttccccataccttttttctagacattttttttcctttcccaacaacaaacacttttcttcatgccaacaccttctctccagaaaacaacaacaaaaacattgttgttcagccctcaaaccgcaccaccttgacctatatctctccacatatcccctttcccttccttcaacccttgtgttcctgttctcccttccattccaccatgggcaactgttgctcaggtggcaccaatggcactgaggacaagggagaacccaaccaaccaaccaacaacaacaatggaggcggaggtggaggcagaggcacaaccgcacccataaccaccccaccaccatcatctaagcccaaccatcctccttccaagcactcgaagccggccgcgatcggccccgtgcttggaaggccaatggaggacgtgaaaagcacttacagcatagggaaagagctagggagaggccagtttggtgtgacacatttgtgcacacacaagagcacagggaagcaatatgcatgcaagaccattgccaagagaaaattggttaacaaggaggatatagaggatgttaagagggaggtgcaaatcatgcaccatctctcagggcaacctaacattgtggagcttgttaatgtgtatgaggacaagcaatctgttcatttggtgatggagttgtgtgctgggggtgaactctttgatcgtatcattgcaaagggacattacactgagcgtgctgcggcttccttgttgagaaccattgtgcagattgttcacactttccattccatgggggtcattcatagagatcttaagcctgagaatttccttctcttgaacaaggatgaaaatgcacccctcaaggccaccgatttcggtctctctgttttttacaagcaaggtcaatatttctcacccagaaactcttctagttttgcttctttctttctttatttattatcatgttttattttattaaaaggagagttagtttagcttccgtggaagaacgtgcatgacatgtttgttttctagggtcatggaaacggtttgcttagcatggaactaataattggctcttctgtcatgtttttttataattaaattccaccatgcgtaaaggttttttaataaacagaatgtgactgcaatttgattcaagatctttgaaatttatgtgagagtgtgtttggatagagcattttaaaatttcagagcattcgaaattaagggaaattgaaatgcatcaattaaaattcttggatttttaaaattccttgtttggataaatcaatttaaattcctttaatttgaaatttcttgtttggataaaacaatttaaatttctacactgagcattttcaataaaaaaattttaacttgagtttgttaagttattttttgtgatttctaaaatgtcctaagtaagaaatttatatacaattttactaaaatgataagaaattttaaaaaactcacttttatattttttgaattattaaataattaaatacaatgacattaaagaaaaaaaagttaaataaatacatatttttattattaataaatagtttttttagaagatacaagtcttattttaagaaactctcactatcatatagatttgctcgaataaaaagaaattgcaagaaataaattcttcacttaaaaaatcctccgaaaaaatttcatccaaaatattctaagaaatcatacaagaaacagtttcgtctacaacatcaagatttttggaatttctgtgattttattgattacacttgtccgtagttttttacaatataagaatcactacaaaatgtgacaccaatttaaaacttttgtagtagatattgataactcataccatcagtgccaccttttaatagaacttctttttgatttttatttagagtttttttgctataagattgaatgtgtgattaaaaatcaatagcttggagattgcttaagctatatgtaaacagaattatcaatatatttgttgcttggaataatcttaggatgataacacaatcttcaaattcgaatgaagcatactctaacatggaattcatccctttttgacaggagagatgtttaaggacattgttggcagtgcatattacattgcacctgaggtcttgaaaagaaaatacggcccagaagttgatatttggagtattggtgtcatgttatacattcttctatgcggtgttcctccattttgggcaggtttgtattcatttactcaatcttaaagctacttcttagttaacaaaatagaattcttcttaaattgatggtatatatgcacaatttgaaactgaaaccaaaacatatggtttgacagaatccgaaaatgggatattcaatgcaatcctacgaggccatatagactttacaagcgatccatggccatccatttcacctgcagcaaaagatcttgtaaggaaaatgttgcattcggatcccaggcagaggctgacgtcctaccaagttttgagtgcgtataatattgacttcctttctatgaacatcttgaattcaactacgaattattgatttgcaaattaatattactttagcccagacaaattggttcaatgcaattctaataaagccctttttttattttatgtgaaaaacagatcatccatggatcaaggaggatggagaagcaccagatacacctcttgacaatgcagtactgaataggctcaaacagttcagagcaatgaacgaattcaagaaagttgctctaagggtaatgctattttagctttctctttattcttcgtgcatatttacactatcgtgagtctagttagaagtggaaaaacaaactaattatcctgatgcaagtcacagattataataaactgcgctagaaaaactgaaatttacttcagactcaagctcagtttttggcttttgtgagttaaatccggaacgggtttagatcatatcggacaaaaaaggtctctttgaatttgaatttaaaaatcaaatcttacatttcatcggccgagttcagatcgaacattattctacccattgtttaggaaaaactgtatcacaagactcatgaaatagtgtagtattaaaatttatatattaattaattaatgtgatgtgaaatcaatatatgagtataggtcatcgcaggctgcctatccgaggaagaaatcatgggattgaagcagatgttcaaggggatggacactgacaacagtggaaccattacaattgaagagctcaagcaagggcttgcaaaacaagggactaagctaacagaacaggaagttaagcaattaatggaagctgtgagttatatctccttttcaaagtactgcatatgacaaaataacttcccatcagtaatttctctgatgccattacttaagactattttctttattttccttctgtatattataggcagatgctgatggcaacggaaccatagattatgatgaattcattaccgcaacaatgcacatgaaccgaatgaacaaagaagatcatctttatactgccttccaatactttgacaaagataacagcgggtaaagaaaaagcaactagattgaatatatatcagccactcctttggaaattgattggtgttaagttgtaggttctaatctcattgctttgtcataatcaggtacattaccattgaagaattagagcaggcactagttgagtttaacatgaatgatggcagggacatgaaggaaatcatttcagaagttgacgcagataatgtaagtcctatactggatgaattaaatactcagttgtaagaggagtattggcaccctcctgctaacacattttctattaaagtatttaatggtcaaaatttatcaaaaactacaaaatcataaaatgaaactcattaaattaattgagacccagaagaaaattatgtgattttcaataaattgcaatctataataaagaatgcattgctaacacttctctagtttgaatacaaaaaactttctatagcatatgtgcttaacaattagcatactactgtacagcatatctgaatcatgactacgaaaaattctgaaaaacttgtatgtctgtgcaggatggccggattaactacgatgagtttgctgcaatgatgaacaaaggaaccctagaagttggtaccaagaagaggcgtgactcaaccttattttagttggagacagtgtaaagatatttaacaggcatcatcatctctttaagcagtgtcaaggtggaaaacaaacaaatttagagggggaaaaaaacttaaacaaacctctgagaaatgttaacatatgctaggtatttgattggttggttttggtttttacttttccttttcttatgctgagaaacattgcaacaaatcttgtattgtaatcactgctcacttaggaatcaaatcaaaagaattatttatttatgactgaatctactgattccttttcaacactaggttcaaatacattcattattattattaagtttatatttttattacactaggctcaccaaaaaaattcagattaggaaaacagaaggataaccatcacggaacctcatacacttgacttgcagaaacaaatttcattgattctcattcaagattttcaatacgaagatgggaaacagaacattgagaaagaaaggaaaaacctaaatttaccaaagagaaaagtcctacaaaaagctgggagcaacaatgttcgagtccccccacttcagatttctgaaaatacaacaaaagaaataaccaagaaattacccctgtattgtcatccccctcttttttgttcatctctctctttgtttcttccctctctccccttgctaactctctcacgctggcagaagcataaaccataatacattatataagctttccactcttgaaactaaagctgaattcagctatgcatcgatattcaaacgtaacatcaacgaaattaacactaattccattcactacaaattacgttgtagagttcgaagcaatgttcaattcaattcactcaaggcgtctgaatcgcactcgaagaaacatcgccacaattgatcttaaacgtttatactagtattcaatagcaactcgaacaacgacataaatacagagacgagtttctcgaaaacccctaactaacaaccacaaggcattgcatctccaatgaatttatatttcatttcattctcacaaataatgatagcatcgtaaacattaattcatagtcacttatactaaatccaacaataataagaatacaatataaacaccaaacagagtctcgaaaaccctaaccctaaccctaggcttttccgagaaggaagtatttaattatttatctttggtggagacgccgtacttctcctgcatgcgggcgatctcgtcctccttcttcttctgatcgaacttcttgctcatcttcgcttgctggtagtagagaacgatgaggtagcggttggcgacgttgaagccggagaggtggtcgacggcggttttggcgtcgtagatgtcctcatagacgacgaaggccgttccgcgagtgtccttgttggtgccgatgcggatctgccgaatggcgccgtacttgccaaagatgtcgtacatctcctcgctcgtgatgttgaagggaaggttccgaacgtacagcacgcggttcacctccggcggcagccgcgtgttccctttccggagactgatcgccgccatcgatgcacgcaaaagtcagggaaaattcgagagagaagaagagaagtaaccttcctgttagtttgttttctgtttggttgggctcggtttatttagtgtcattgggattttctttctacatctaccatatttcttagtacacccaagagaggaaaaatcgaaaataattgtcaattcctatgggcattgcaagtatcaaacatgccacattctattattagcataacactttaatcaattaaattaataaatcaattatattaaaaaataattaatattgtcatatataatattaaaatttctaataaattttataataattaattatttttaatataattattctattatgtggtattttgagacctacatgaatatctataaactttatgaatatctataaactttattaatgaaatctgactgcgttcttaataaaattggatttaattccactctgataattgaatttaattccactcagaccagagtagttgttggccgctccagttaattaactcaatccttaggtgaatgagattatacttaaaacagtacctttcctaatagagctaaaacagttttttatatatcatatataaaaaaatatgtcaaatatctaatattttaaaaagacacaaaaactgctaataggaaaattttaaaacatgaaataaataaaaaacttacctttaattttgttgagaaaagactcattgagaatgagaagtctgttccggataaaataaacaaagttctcaccatataagccatcaaagaaaagaagaaaaaaaaacttacctttaactgaagtgttcgaaagcacaatccattattgcaccgccattgcaacttattttttgttctttccagcagcgatccaaacagaacaggctcctcgttgactgagatagcaactccgacacttgagttgagtgtgtctggtcggaacagtatgcagttcagtatcacatcacaattccttcatatcttctctcttaccttcttcattatcatcacctcttcactttcacaatccaaccaggttcacttctctatcttatcttccttttcctacatattttaattttgcactatcgatgtacaaaattttaatcagaatagatatgatttttaagttagttattgtaaaagtcaacggacttattaccgcacatacaaaaattgtaagtgaatgtcagtgtagaatccgttacactgattttcttctcttctgtgttgacctttgctcaactaatttacttatcccgttctacgttatcaaagagtcagagcttcgattcttgagtgttttaactgggtatgatcattagtactgattactgaactgagatttttatttccaatagttctatgcttgattttctttttcgaatgatttagttttgtgatgcgggaactgaaattccatcatccaagttgttgatcaagggtggcacggttgtgaatgctcagcaccaccagattgctgatgtttacgtggaagatggcatcattgatgcagttaatcctaacatcagggtaattgatgaattgaaaccccctagcagtaacagtgcttaatttgctttctaacaccttgcgtttttgttactttctgctttctgatgtatgattcatttccattcccaggttggagatgacgtcactgtcattgatgccaccggcaaatatgtcatgccaggtttcaacctattcaattatatttcatcacctattattgttagattaaattagaatgcatgagctggtgtaaactccttggtaactgtcttcgattcctatggataaaaataaataaattagaatgtgtggatagtatacatattttttaccctattatctcaacctcaaatttaagatagcatcggaccaccctatatcgggctgttgtcagatcataaatgtccaattttgtacacttcatgccctgttgactaacaatatgacaaaaatagtatataagtggagagcaacccattgccatgtatgctaattttgatgatttttatgataactaattaaaaaaatcataagtcgaatgatttctaattggtaaacaatgtaaaaagtgcatgaaaattaatttatcatcatcatcgtcatcgtcatcatcattattgttgttattattatgtgcctaatagactctatgaatgctccttttgttaactgaccaggaggcattgatcctcacacccatctagatatggatgttggttttactgcaacggttgatgacttcttcagtggtcaggcggcagcattggctggtgggacaacaatgcacattgacttcgttataccacttaatgggagtttgacagctggttttgaagactatgaaaagaaggcaaagaagtcttgcatggattatggttttcatatggttattaccaaatgggatgaaactgtttcgagagaaatggagctcatggttaaggagaaaggttgttatttattatttccttgctgcattttgataatttggttgattaggtggtagtaaccctttgggtgagttgtaaggaatttattccaggtagtacatctatgttttgtaattgcagggatcaactcttttaagtttttcatggcatacaaaggaattcttatgatcaatgatgagcttcttctggaaggatttaaaaaatgcaagtctcttggtgccgtagccatggtccatgcagaaaatggagatgctgtgtatgaagggcaacagaaaatgatagaacttggaataactggtcctgaggggcatgctctttcaaggcctgcagtggtaatttctcaattttgttcttttaataaagaatttgcagaataatggaatgaaaatattggacattttttttgtttcttttcatcttcattgtctgaccaacctatagcatatgtgaatgtgatttgaactcatatttaaaatttcccttttcaacttagtaggctccctgcataatgaattggatttaggtgctgttttaagctactactatcaaattttgcttgcttgtgaccaccctagtttgacatttgttgtgttcagctttcatctgttatgataaactcattaaccatgtttagccagtattttatcatcttgattacatgttttgttctcttatattttgtgatcactgcaaattttaaatgtctgtctgtgtgatttatagaacattctcccatttgactttgttatctgtgtagttggaaggagaggcaactgctcgtgccattcgcttagcagattttgtgaatactcctttatatgtggttcatgtaatgagcattgacgcaatggaagaaattgcgaaagcccggaaatcaggtccttcaatatttctagtgttagtctcaatttttattaatgtatgcattcattaagagaaagtagatgatttatagcttataaaattagtgatccttttgaagaaaaactaatactcttgcaatcttttttagggagaaatgcaaaaggaagacattttgattgaatttataatatccatacattggttaacttgagaacaatttataaatccactcgtgttttactgttgtctctactctatcatagagtgtagaaactgagggcaactcaaatcacttgaacttaattgagagtctgagacttaattttgattgctgtcttgtgattttttttactgttttcagttacttatgtaccctttttctctgtattttgtacttgtgacaagagcttcctgaggaagattctatttttgatacaaagagactggatttccttgctgctttgtctttattttttcctatctccttgttttgtacttctcttatttggaggagtacttatcctatccctaggtgtactttccctctttccatgcagtcctaaaaaaaaaaaaaatcactgatgaactgaatctctatgaagatgaacaaaaggatctttacaaatttccactgtgatatttgaagtgttattgttccttgataacttagtttttgcaataataaggtaacctgttcttgtgctgcaggacaaagggtaattggagagcctattgcctctgggttagcccttgatgaatcttggctttggcatcctgactttgagattgcagcaaagcaagtgccttcacttgtttcaatgtttttttttattgttgttcttttatttccttgaattttaagaacatataagccttattcattctcatgtttcaggtatgtcatgagcccccctattaggaaacgaggacatgataaggcccttcaagctgccctttcaaccggcgttttgcaggtttcacattatgattcaggcttaggttcaataaccaattaaagatgagggtttgagtttctcaggatagtctcagctatgaaatacacccttcaagctgccctcagctcaattttattcgttttacttagattgtttatttgaccaagggatacctttttaaaatttgtagctggtaggaactgatcattgtgcctttaattccactcaaaaagctcgtggaatcgatgactttcggaaaatgcctaatggtgtcaatggtaatcacatgaaagtcttggatatttgtggcctaaatactttcttgctgattttgaaatgtttccttactgatatagaatgcaacctgtaggtattgaagaaagaatgcatttggtatgggatatcatggtggtaagatgtcaacttccagcttagccctccctttctgtttaggtcggggtaaaatggtgaagagtataaccttttagctagaacttatggtttatatatctcacaggaatctggccaaatatctgtcactgactatgtcaggataacaagcactgaatggtatatattcagttaatcaaagtgcaaattagcttccagttcttatggcaataaaaaagctgtttggtaaagatgcccaaagtattactgatgtttttcatttctacaaacatttcagtgctaaaatcttcaatatatatccaaggaaaggagctattctcccaggatctgatgcagatattatcatcctgaatccaaattcgagctttgagatgagtgcaaagtctcaccactccagactggacacaaatgtctacgagggaagaagaggaaaggtaccggtttaactataatctgttcaacatgtgattgtttgtgtatcgttcaacaattgaagccttgtcattgcaatatcaagattcaaagtttttatttttctcagggaaaaattgaagtgactattgcaggaggaagagttgtttgggaaaataatgaactaaaggtcactcctggcactgggagatacatccaaatgccaccttttagttatctgtttgatggactggacaaaaaggatgtcatttatctaaattcccttcaggccccagtaaagcgagccaaagcctgcacttagaaaatttctgatatcttttttcagtcaaatttcaacatttgacatagtggaaaaaccaagatgttaatccagttctgtgcaaataaataaaaataaatatatttcgttttaccttttccactaatgtacaattgcatagattgtgtcaaaagcaattggagaaaaataaacaatagttttagctaccacgaaaatccaagtggagggtctgaaattaaactaatactgtaaaactcaaagtagttatatgtaagaagatattagtatcatgaccactcaagaagtaatttaatgtgtcggtctcgtattctaaggaaatggtaaagtatgatgatccaaagtataatagctataaccacaacgaatttattggattcgattacgttatggtcaaattttacgagaatatttgcatgagcattcttattcagttccacagatgatgatggaaattagtgttagaaatattgtaatgtagtctagtgtatacatttgggtagcaccaacataaaatgtgccttgaattgactccctggttcaccgtatatcttgggctaaaccctaagaactgaacctgctgtatggcattcttctgattgcatccaatttctattgaaaacagaaaataagttttcaatctaaatatattttctctgtttaattaatctggatcctacaatttgtctcacattgagttttagtgattattatggacagcaaaacaattctcataaatatttgatacaattgcatatttaggatttaaatgaaaagtctcttattaaacttgaataatctcaagtcaagatgaattaagtctttatatctaaaaaaattatgtttttttttctacaatagaaattttatgttttaatccttgttctgttataatataaaagatataagcattaaatcataaaaaataaaaaatgtttgcatagagaccaaataattaattaaatttttattattgttgtttcgtagaaattgaagatttaattaggaatttataataacttaagcattatatttaactaattgggttagacgataattaaactttaatttactttgatttaacttattttttaaatggtaaaaaattagaaataaaaaaattattttagaaaacaggaacagaagataaaaatgaattaaaaaaaaaaaatctcaaaagaaaaggttcttagttcttacgactacagcgcaaaaccctcgagctcagtgggctttggcgtttcactcagtattttcagaacagaagtggaagcacgttcgggatggagccggcattgttattagggtttgaagaagatgcgaaggtggttacagagtcatcatcatcgtcatcaagcgcacatagattggtcccttggttgaactgggatgagtggctattcgttaaaaatgctctcttctccgattctcctcactctgtttcctccggtctcaaacgagtaactttcttaaccatacaaattcataatatagatagacatagtactgtaactgcaaacctagcctaacctaaccatatgttctgctctttcagatatccgcatggcgaagtcgaggttccttgccagttctcatcgaagtcactgcttccatcatcgaaattcaactcaaagacccatctttcaggtaaccctaactcctttccttatgtatgtatgttgtatgtatgtatgtatgtatgtatgtatgtatcaatgtatatatgtactatgtatatcacaataagcaattttgtttgatttaattgtagacatgatcaatggaatgaagcttctatttcggaggagatgcttgctatgctgtattgtatggctatcatgaggtttgctcagtggtcactatacctttttttatgttttttcttcttctcactaataattttttgttttattttaatttttctatttgaaagtataattgttttgatttttcaaggcttgtgaatggtgttgttgagaagacacgcaagaaagaagtggcgtcgatagcagtggcagctgatgcgattggtattccacgcatgctgattgatattcgccatggtgaacaagtttccttttgattcctgttaattattagttttgttgtgctggtagaatgagacacgatcttcattatagtcaaagaagttcacttagttgcttgttttattgtgtttatagtgccctgctttttatcttatttattgctgtaattgcagagggatcacatcgtgagcttccttcacttaagattgttcgtagtgcttctgttaaggtatgactcatttcgtggtttgtttgatcatctgtctcaacaatctttttgcttttttgtaattaaattcttagcaagtgtgtgtggaccttggttggggttacattcttagcattcaggaaattattagactgaacttttctttcccaaagtctgtgtgtaacataacattttttagtatatgaaatagaaatcatgtttctctgttaatggtatcaaaggacagagtacatgcatggtagtcactgaaatctatgctatttggcaacagaaaaattattatttttgtttgtaataacttttagattactctcttactgttgtacattcatttttcgttctgatgaaatttcagtttgttgttaaaatgtaactggaaataaaaatggaaggcatcctggttttcttttgtggatttagctatttgaatatgggcaatttcttcataagttcttaacatgtatggctattcccgtcacactaattatgtttaattcactccccaaactcatctgatgttttgctaataatttcaggcacttgattggttaaaatcttattattgggaacctcagagcaaagcaattccttttcatggtgaaggaatagcaaaagtcaacaaagaaattaagtctaagattcgtgaattagctatctgcttgaaagtcaatgggagtgctcagtctagttctttactactaaaagcaaaacgtctgtaagctttgttcattttgatcatattgtgactttaatcattgtcttgcacttgtttattttaagtcaaatactttccttccacctattcattaagagttctattttgtgttttcctattttccgttttatttatgtacatgaaacttgtgcacatgggaaagcatgtaatttaatgttgaaacttgaaagtccaatttgaaaatcctttggcccattataaagtgtggtaatggtagtatatggtaatggtagcacatgtcaaggcatttttcaattattaatggatgtagagttattggtgtagtatcatattcaaatgtattctaagtctagacagtatgggttattttgttggtaagatgacattcaactgcatatttttcctacaattcttatgatttgttttttctcttttaaaggggtcaagcatggtgaattgctttttgggcgtaataagcttttgtctcttatagttggcaagagtcaaacatcacgaaccggaggtatcattttgttcatatttcttattacaataaaacatatttgttgtgtttgtttagtatacctgttgtgaaaaactgccccagacagagaaatttatactgtgcaaaactaaagaagaatttctttaataagaaaataacaaaattacaaagaagaattctctatgaattctttattggtagaaaatcaaggaatatcagtggctaattattatgaatatcatcagtttatttgtttccattatttcctttattaggattaggaaatatgtgatctgatatgttttaattacagtaggatgagattattttccttattacttattatttagtttccttattttgtaaacttctttcactataaataagagtattttgtgtagtcttagatgacacacaacagtaaataattcacacatgatatcaaagcaggttttcgttcctaaccttcagcctaggctgaaacttgtttctcgttgtctatgttcttccgctaacggctctattgctctccctccaacaatgggtgactctaaaagactgtaaggaaggctcttgcattttctgtgaagctcagcagcatatttcgcgcttcccaatggggcttgcattgggagttaatcatcttgaatgagtcagactctaccctgctgattttcactataaataagagtattttgtgtggtcttagatgacacacaacaataaataattcacacattatttctcacatgtgtgctctctaaagtatttgtatccttatgttttctcttaatgaattgaatgttacaaatcccttgcacctatatatactaaaaaacaagctaaataattataggtacaaaaacactctcatcctcaaccattcgtatgagtgttttacattaactaaaccatgaaacaattaatggtgtgcaagggatgaagggcaagtcatccttcaaaagagaagtaaattgtgtctaaaggccacataacaaaaaataaaagagaaaagaaaggatgcaacaccaattgtgtctacttaacctctcttaaaggatagtgttttcttggccaatttgttgggtttaaatcacaggttggtttttgagagttcctatgtggattatgctaaaagattggtttaccttgttagtgggtgttctttctttctttattgtgttcgttctgctttaagaggattcctggccatttcatatttttatgtttctattttttctttctttaaaactcaagtgttgggtttccttaaagctgatcgaccaaataaatgagagattcctaatctgagatattggatatttttattttactatgaaaaataagtgaaactgaaataatttgttttagagtatcttcagctttaattaatgtttcagggtattcatgtactaattactagtgaatcgtgatactttcaggatctaagaaacaaattaggaagatcttgaaatatgttcttcggttatattcctccttttccaaagagattgtttctgtgttgttggagtatttgttgaaagctttaagttcctcagagttggaagagaatgcagatgatgcttcaattggtctaaccactcagaatgttttggctgattggatgcttgtcatactcaaattgtgcaataaggaaccagaattacttctgaaccttcttaaggaagtccttgatatgattgagagtcgggaagatatgaagtataaagaaggttggtagcaattttttccttctacagtatcccttttcattatgtatagtttctggttgaaatttaatatctgtttgttttggggtacttgggatgtatttttcttgtgtgcttttgtcatttgatgccccatttatttacttattaaatgccagatactttctagggctttttaaatgcactactaatggaaagtcttttctgattggattccctttagtatttcttctgccttgagccaacgtgaagtcagatattgagttttaaatttctcttgtccttcattttggtttggtattacgcttagtttcttctttattgttctcatggtgtgttttctttttaaatttttgtagataacccaaatatgggggtttcacactcgagaacagagtttcggctttcttctttgtttgcatggcttgttggaattctcagtaaagttccttctgcagaagcaaatatgccaaaaagagttttgcatgaacttcttcgtagatgtcttctagtatcacaacttttcaacaagcagctcgtggattcagcacttcagcttgcagagctgatgaacgacagctacttgattgagaaagttcgaaagttctctcttattagtttgtccaatttagagagtgcagatgatgaaagccctttattgacttcaaagaacattttccaatttgaggaatccatgctcgaagcagctaaaaagctagagttagttaaacaacagataatgaaaaataaaaaaccaatggcaatggattgtgacaccgaaaaatcacagacttggactttggcaaaatcatggaacccgtgtccaattggcatgttgccccgtgctgttgggtcatctggttgtcttcctgttcttaacattattgatgatgaaaaacagaatcaagtatcatcttgttgtcttcctgttgatgacattaccgatgatgcaaaacagaatcaagtatcagaaaaggaagagaattggaaattgaccccacacggtgccaagagagatgcctttttagatctcctgcaacttgataattcaactgtcaagaagatgagggagaccaaagaatttagtgaattaaacaatgaattgccattgcaaggggagaaaggatgtcccatggtaggcggagtttggaagaaacttacagaagaagagctactagtcattgagtcttctgtaaggattttagtttaattcatacttactgcttagttcttttcaagatttaatccatgttagttttttttattcttatttgtttgatttcttttataaggtatggtacctatatgataacagatggctggccttaaaatatgcaattccacaaacatagataatcctgtagcttaattacctgaaccacattcatgcaataggaatttcattctacattcttttgcccttctccattttcatttgtgctgagtgcattcgcaatagattggaattggatgccaatgctgtatcatggtagagaaagttcggcaggggcgacctgagaacacatgagctgagtcacataaaaggtcacaaacaaatatgcttgtaatctgaatctgcttcatgtggtctcaagacgaccctgtagaaccctctacctccacatattttggaaatgtcttcgcctaaactggaacattggactttgaataatgtttttatcaatttgatgagtttatccaatttgataaagtagatatatagcccttgcaagcgtggtacttctaggcttagatgtactacgccgaagtacttttattagtaatgaagggatctctgttccgttaagagtacaactttgtactactggttttaacacaaatctaagacgctatatagcagtacaacttcccgttgctaacacacgtcaatgcacttttgtcaaaactaaaaagaaaggaaaatcgaaaatgcatatgcattacgatgatttaaaataaattttgtatcttacagaggttgaattgtaacaaaaaattatttaaccaaaaaaggtgtaatttaatttcaaatatggctcaaatgtcttaaaaattggttgtagtttaggtgcgcaagaatataaatttactttcgataaagtgagcgtttatttcaacaggaaccaactagtttctattatattatacaaatattctaaatatagataaaatttaaaaagtataacttgaaaggaaaaaatatttaaaattataaatgatattatgcataattaatttaaaattatgcatagtcaagaaatatacattgaaagaaaaaaaaataaacttgtaacgaagcatgtataatttatttgaaagaagaacagttaataaggtgtttttttttttttataaaaaaaaagaatgaagacttgaaattaagtttttaagataatgtactctaatttaatatgagtggaacacttagatttgagaaagaaaaaaatttaatgtaaaaactaagctaaaaaacaatgaatatgagaatataagtagtaaaatttgaggaaagaaaaggaaatttaatgtaaaaagggacctaaatatatatatttttttgtgtataagtaacagagatttaattcatatatatatatatatatatatatatatatatatatatataaagtgctgagcgatgatgaaatcgtatatctaaagaaagtacactattagattattttaatccaaagagttaggactttatgttaacacacggatggataatgaagaatatatcaaaaggaaaggatctaaatatattatcattcatcttttgttaattgtcttcacttttctctctaatgttgttttagaagaaaaaaaattacaagaaaggaaaaaaggagtcaagtgttttatcccgtctccaaatggtgtagcccataaattatttatatgttaaactcttaaatataaaattaaaaacgtacaaaaatcaaaatattggcatcggagctaaattcgaacaattgataatcacgaggaattaaatagcatgcctactttgcattgcaaaaatgcattacggcattactttgactgtgacgagggaaaaaaaataaaggaaacaaagggtacctaagttgctaaagattagagaacaaaatgtatgcatgcagacatggaagagagtgaaaggttaaaagcctatgaaatttccctttccatttacttttaaatacacgaccatatggctgaatttttctaatgctctttgctttctgtacactgcttgacctaaattgttgtctttcctaggtagaaagaacatcatgctcctctctccactaaccatcactttttcaccttttatcccctctaaataacaaagttcttcagagaaaaagagaaaggaaaatgcttggtgttgtgattactgcttctgacaataattctttagtcatattctaaaccaaacccactttcaataaagaaacaataatattgtaaacatatcttaatcttagtgccgttttatttttcttacattaccaccttacaccaatttatcatcatttttacgtgaagaatgtaactatgtgcatatatacaatgtaattaaaaataatgaaattaaaagaataatgatatataatcaatcacatttatagtattttccagtggatactttttcaatgtaaagaaagttttgcgcgataaaataatattttatatacatgggacctagttaataggaaaagagagttatacagtgtgaacgtaacaccactggctagacaaatgcatgagaggtaatgatgcaaaaatccaagtaataggaacaattactttacatataaatggttgatagactaaagcttgtttgcattgccctccgcgcatgtgaattttcatcatttggctgagatgtggaggtgaattcttcatgttgtaatgaagcactccttcgcaggaagcacatatatgattcgtatgactttattaaggtagaaaacatcaaatcagaaccccccactaagattttcttttcaaaaaaaacaaagaatagtttctcgtccactaaggatgaggatatgtaagaaaagccagtgcagtatatataaaatataaaccacacatgatatatgtattgacacatttttcattctattttattatgaataattgtattatctgcattcctgccaatgtttaccttattagtaacttcgccagaaagaacaaaaggaaaagaatgaaattttgatatattattcaaattttctcaataccaaagaatatatatatgactcaaagcctctcgactacggtaaactactgctaattaatctttattcttttagtttcttaattttattacaacaaagaaaaaaagaattggatctaacttcctcaacaaacgtttgatatcatcgtccacatcatatataacttaaaatcattagtttatgttttgttttgtttaactgaatttgaaaaataatgaagctgagttcagtagaatgaattatgcatatgtagtactatacatgatgcaaacgagcctgatcaacaaaatcatattttgggctaataaacttcaaaggttttttatgcattaagttgatggttatagctagctatcatttttctttgtaaggattgtttattccctccgttaaaaatacagttgtgggtgcatgttataaggggttcaattcctcaagtatataaaagactttgtttggagagaaaatattcactttggtgatttttacatttcgaaggaatttaatctctgactatcggttcagagatacttagcgtaaaacaaaaacaaaaagtatggttattggtcttcaaagctcttgaacttccaaagatcgaacatatatttaagaagagccacagttcctgttcttcaaatttcaaaggagaaatcatgcaatttaacctcggtcttaacttttacaaaaaccactaagctttcaaacctcccctttttgctaattaatccaataatagtcacttttggaagcatcttcttctctattttaatttagttgccacatgctgatcttcacatgttatgcatttagatttgtgcatgatacataaaagacaaaactctctctctttctatctaaaaaggcatgcagtgggtcacatggatggagatagatcatgtgatgcaacaacatatattgcccatttttactggaaactggaggtgttgctaatattaacttagaatagaatcttctcattattgagatatttatgtggacctttcagattcttagcagtgtgatgcagggtattttagaggcttcctagctatactttgaccaccaaaaattcaagactcaaaaagagatgcttggatgagaaaatggagctagctaagtatctcacttaatttcaacacatacattttcaaagcaaaagtgagagagaaaagaagagtgtggaaattaagaaagaaacaaactagaaagaaagtgatgaatgtctccaacaatggaatccagagctagaaggttgtgcacaacattttcttccttctctaatgtaattaggcatagcattgaaaattgaaattaatatatatatatacaccttatctggtcaaattacagaagattcacttatataggaattgtgcagtgtatatataaatacattattccatgattgatgactagaaggagctacgtcttctatatgtccaggtcacgggtgtgctttggattgtacaaaaatgaataaaggtcagaatgttctaccttgaaaactaggtacgaagcactttgagtgtttacaatttatataatagccttatttctattatgttctgtagttatgtacaggaggcaaactttgacatatagctgtagtgggaaaagatttaaaatggtgatcctcgtgatcacaacccaacagtgatccccacaaatatccctataaaagaaaaaaaggtatttcttcagaaaataaagggcgggatggacatgatatctggaaaaaaaaaaaaggaaaattacaaccacataattcttgaacagtgtttatcttttctggtttctgagacactacttttctcaagctggaaatcaaaaagtcatgatttgggtgatctaagaaagtttctatcccatcaatccttattagtactttatttgaatgggattgttgaagcatggatgagattaaaccaaagaaggaagaacagtactactgatcctcacttatgtgtaaatgataatcttgaatgatcttgctagatatgaatatctgatgatgaaaaataaaaaatagtgccatatgcatatagtttcatgtaacattttatagtttagtttatcttctttttttatctataatgtgtagtgatgtgtttcaacattcaagtatcatgaaagaatcattattcaaaaataaaatggcttgtttccttatagtcatatacttcctttctgacttctaaatattcattttggatggaaattttacataggtatcattcaggggaacttatatatatgattgaaatttaatacaaaacagatcagtccaattagcaaattaattctcaattacagatgccaaaaagcatgcgaagttgagaatacctcctcttttattggaaaaatatatatattgcaaagcaggctttggttctagtttccaagtaaagacgagggtggaggagagggagggaccaacaaattgaacaacttctgacattcatatataatagtgggccaatgaatatacataaaagtaagtattttctctttaagttggaggactatcgcaaccttccaagtttcagttccacacaatagtatgtgttatacagaaagaaatacttaaaatatcacctttctatttaattattgttctaggaatttgcggaggacatgagatctttgtatccataaaaaatcactgtattatgcagtctttacaaatttttttaacttcaaactcaaatgaaatgatctaacaaccccatacacctctccaaattttggagaatatcttataaaaatatatcccactgtttttcctccaaaataaaatagtaagtagctcacatctctagaggaatcacaacccaccactattgcatccgagaaaacaatcaatagctaattaatagctcattgaatcttaataattatatcctatcctagaaaaatacattgtttttacagacatggtcatatgcttcttaaatttagtaaacaacagacataatagagggggtaggacaaagaatagttatttaagaaatatgtcatatgtttctgttgcataaagctgtaaaattataagagtaatgatatatgaatatcagcatagttagtgtatacacttagtgaacactttttatttcttttatctttcttttcttatcacatcatattaactatcatatttacttttctctttcatttgtctctatctctgtctaagtgtctagtagcacataagtgtccatgcatcatttttcaaattataatatgatagagtgagagaggttctttaaaacttggtggtgtgcaaaaagtgaatgaaaaggagagtaccatcaaagaataatattggaagcagctagccctctttggtaattcagtgatggctttcacactagacaggtgtgaagatagcatggtgttcactatggaatctctcaagtcagtgcctgctccctttttgacaaagacataccaacttgttgatgaccctcgcactgaccacattgtgtcttggggtgatgatgaaactacatttgttgtgaagaggcccccggagtttgctagagatcttcttcccaactatttcaagcacaacaacttttcaagctttgttaggcagctaaatacctatgtgagaatccatctcttctatatatataacttttttttgttctgatctatccttaattattgcttttgtgatacacttcttgacaaagttagcctaatcatattaccaattcagagaagattattttttttgtgctacacttcttgacaaagttagcctaatcaaattactaattcagaagagttagaaagtggaatcttttgtagtataaaaacttcaaaagtattttccttcactatttgaactataagactaacttatgattacctagctagctacacaagcttcatgattaactcatgtttgtgaaacagcatacacacacgtatatatacctttccttttttttttctttttcagggtttcaagaaggtagctgctgataggtgggagtttgcaaatgaatacttcagaaaaggagctaagcatcttctatgtgaaatccacaggagaaaaacccctcaccactatcaacaacactaccacatgcatgaccaaccaccacatcttcttcagccagatgaaaatatgtgctggattgatactcccccattaccatctcctaaaccaggcactgacatcttaacagcactttctgaggacaaccaaagactgaggagaaagaacttcatgctcttatcagaactcactcacatgaagaacctatacaatgacatcatatatttcatccaaaaccatgtaagtcctgcttcctatgatgaacaaagaagaagaagtgctattctgaagctggtagaattggattcatcaccaaatgttattagaccagctaagagccggattacggagaagtctttggtaatttctagtgatgagcctaatagttctgtgaagctctttggtgttcctctttgtggcaaaaagagattgcacccaggtaaccttgatctacaagaatagtacttcatagtcagaagaactttacatgatgatttttagcttattgtattggataagcaggtctctatcgactccaattaatttgagttaaagatgttgttaatgttgatgtacatgttatgttgtatgttgtattggactgatccatgattttgttgacatttgaagagaagcattgtatagaagaggcttgtgttcagattaacaagattgttgtttctttagaattttctagtagatgatatgtttctggaagaaaaaaaaaagcaattattttcttattttggagtcaaaaataaaaataactttttaattaattaccttttttttttatcattttttttagtttctttctgttttcttctttctttccaataagttttttgttaaacttaattaattggataaggtgaatgagttattgtaaatccttttgagactgttttcaatcccgacaaataaaaaaaaatatcatcatataaattttttttactataataacaaccaccaacatgttaaggttgctgccccttttattatttaccggggacccaattccaacacttccacgaagaaaggatccaaagtagtgactacaaaatgacaattattcctgcaatacttcaaatggacgacaatattttttcaactttgattttgaagtgtatttttttagacatgtatatatgaagggaaaaaagtgaaagataaaaataattatataaagtaacacattatttttataatatcttctcacagcatcttttatatataagaaaagaaataaaaaaaaaggaatgtaagataaaaaatacgttatgtagtaaatattttttaaaaatggtttgtataaaaactgttgtatataagaataatatattgagtaaataacgtatgtatggatagtgtaaaatatttttatattatttaatcataaattataatatataataagtttattaactcttataataattaataaattaaaatttatattaatgataatttctaattaattggtggtgtaaaattatacggtgatgaattatacaataaaaccgtctatataaaattaaactctttcataatgtaaaaaaaataataatctctaactctaacatatataacgtactatatataatgttattttacattttttatgttcaaataaaaaaattggtgtgcatttgtatcttggaatgttaatgggggcaattcttctttcaaccgttgtaaacagtatatggcttttcaagtcgcaaagtttagtctctttgcaacacaaaatcacatatatagttgagacttcaccaatacaaactagacacttacactttttagctttttaacaggctaaataatttaaagacatattaatcgaactatgtcttaaatatattcctaaactttatccaaatttttaaataaatcattattattataagagaaagatgggtaacaatttatctgtgatgattagaatacaatactttaacaaataaaagtgtttccacacatttgattttatatccgcagtagctcacatggttaaattctaatgttgaatttccgggttcgaatcccggctgcggaataattttgaaaatatttttttcttccttttttttctattcttttaacaagctacgtcaatacttcccttgcatagttgcattattaccattctcaaactatgcttttccttgagtaaaactttgaattaaggctatttatttattttttaggaaaggctcgttattttaaaaaaaatacattcaaaagaattatttgataaggtgtaagttgtaaatgtcaaaacactaatttacgacttctgaatttttaattattcttatttttctttttaaagtcataaaaatttctgacttgtcatgaaatctaatttctttagaagtcatagataaacttgtaacttcttattttttatttatacgttggaaatagaagttgtagaggatgtttgagacttaaaaaaaaaaacagatttattttgtaggttttagttctagtttaagttacgtaagttttagtttaatatttttaaaatttatgaattaattatgtttgtaaaataagtattataaaaaaattaatataattattttaatattaaagacaaaaaacgtaaattggtgaggaaagtttaaaagaaaaggaaaattaagaagttgaaatcttgactacgactttaaaaaaaaacaaattcaattttttgaaatgtagccctatttggtaattttagaaaaaaaaaaattaccccccttagtattacaaccatacaagtgaaagaagaattcaaaaactttatctttattttgagttaaagtatagtgttaagtttatttattgattgttcataatatacaaatcttttttatgtttattccacaattacacaataaaaataaatagtcttattttaaaaaaataaaatagcgctatttaatattttttagatctgtgattatctcatattggttaattggcttaaccctcttgctggagaaaaaaaaaaacttttgaattcattaaaaaaaacaagaacattgtgtgacttacaagttggaacccaaaaatgaaattaaataaactaacttgaaaataaaatgagttaactcattcaattctttaaaattcatcagaaagttttagaataatctccagcttcaaaaggaaaattattataatgcaaatttagtctgcttatgactgatttttttctttagaaaaaatatttttgatgactaatttatggtggcttgtctaaatttaaaaaaaaaaaatgaacaaaaaggcaagaatatttaaaaatgggtaaaaatctaaaaatagataaatattaagtctcgcctaaatatgacagattccattgataacaatcaaatcaaagtcataaattatttatcatagttatttttgtaatctttagttataaaaatattagaatttttttactgtaaaaatattagaagttacgaaatcataaaggggtcttattaaatatgaaatagaacctaaataaattttgtatttttaagtcaattttaattaataataaagaatgtgttaaaaaagcgtattactaacattttgtaagacacattggtttctcattgtaaatttgtaataatgttttttcatcgtacaaaaaaatccacttttgatattaaaaaaaaatcactttcttttaatcctatcaatttctggcttcttaagcccagtgatatttgtttacaatttctcataattgtcaactaattgttgtggtaattccttttcctcctataatcaccaagatttagcaaattttctaaagcaaacgcatatgattcgaattaaacattatataataaattacacaatttggtgcaatatcatcacatccgcagtagcgtatttggttaaattctcagatttgaatttccgggttccaatcccggctgcggaattatttttccgctacattataatcatattggcctaactaacttacaagccaaaatgaaattaaataaactaacttctaaagagaacaaaattgtgttagtgtgttaactattattaagtcattcaattctttaaaggattcattatatattttcgttgatgagaatttgaatcgacttaaagtacttttgattcatctaaaatctcatgtcctacatttaatgtatctaagaatctccatcaagaattctctatgcaagacttaggtcacatttggtttgaacgttttcagtttttatttttaaataaaagtgaaaatatgtttggttaaaatttagtaaacatttttcttaaaaaagtattttcaaaaaaaaaaaatccaaaattgaaaacaacaaatcaaccttttttgcatttttgaagaagtgaaaacatagtaacacttttaaagtatttcctttttgataaatatttttgaaatcttaaaaaatagaaaaatatttttcttaaaaaaaataaacacttaaataagtgtcaccttacatttttgaagtctttttgtcctggcacagaaattatgaaacttcattattcaacttcacttcacttctgttatctaaaaaaaaaaacccttcacttctcttgcttattgttaagggtctcttcttcatacacctccaacaatatcactttacaccctcttttactatgaaagggttaattcaaaatgaaggttttatattccgaattatctaatctagaatttacaaggtatgtaggctgtgattgttggggtgcgggaagaagtggtcaatgctaagccattgttcaagaatcaaactctttttttttttttttttacagatcaagaacctaactcttattaatagtattgtagatattactcttgctatttcttcctacactcaatttttgccttccagaatgtaaaattacatttcagaaatgcactttctttttggcttccaaaatgacctatctggaaggtcaaaaaagtattccgaaaagagtgcagaaagtaacttgggaaatgcaggaagcaacaaccccaaactccacgttcaagcccaatcccactctatctcaaaatcctgcattactggattttatttggcagaaagattgggcctaagaggcctggatatacagtgctcaattggatactcattttaaaaatcacacgaacaatttatatttatgtataaaaaattcacagggaccaactaaaagtgcgaaaaataatcatctagaaatgtaagttgactgttttagcatctggcacatatacagttcacattcatagatagggaaagagataattttatatggacaaatgtgtgggataggtgaattcaaaggtggtgggggcttgatggatgagatgttcaaacattaggggacaaacaccaaaagattgtatgcctaagtggaaatatcaaagcaattaaccaaagaggatatgcttaaattatatatatacatactttctatttcactaatgatcaacatgaagaaatgaaaattttgtttatatcatttgctccatgacccaaaatgaaaagtaatacaataaaaagaagggaaaaaaaaaaaacactaatcacacaaaagcgacttctctaaaagaggacgtgtcagcttacggttagtgacattgtgaattatcaatttggccttttgtttaaccatgcatatgcatttagatatgatttccgggtttctcttgaaaatgttatgcacccaaagggcaacattatcaacccaattgcttggttgatgaaaattctaacttacaagttctaatccagcattattacttttaccatcacaagccactcaatgccaactaaattgtgaaacattatatgcctatcccaagggaaccagttttgtactacaattcataccctattgtgctaagtgatcgcacccattgagccacgttgtccacttcatagaccaaggaaaatgtttcttttcaaatatgtcaaacttgtaggactactaatttttgtgctaacaaggtgagcttgctttagcattatccaccattgaaattcaattcgacagaaaaagacttcactctctcgatccaaccccaattgttgacctgaccacactcaaaggacagaaactactcaactacattcattgcttttaagttttatcacaaacaaaaatgaaggaataacaataaaagtcaccagcgtttaagtgtttgacatttgtggaatcccttaaattaataatgcttggtcacggcactacttcttgacctctaatgttgcgtgagtacaattatgtaccaatccgtcccatttgattttccattgttacaaaatctagtccaaactgaaaatgctgagcactactatcatcgatcagcacaaagtaattactattgttggtccaaccaagtcaaagaaaaaggcaatgcataaaaaaattgtgaatttttttagttaaagaattaagagtaattgttagcaagaatcatagattacttataacctttttaccatcaaatagtttaaggattaggatattaatgaataaattatctaatatctattataccaatcatttaaggaaaaatgacaatgcccttttaatgttacagtctggtctttaattggctttacaatttgccaatcatcaaaagtcctttgtgtatttatgtacaaataaaaaatattactctattttcaaggttgttattctcgatatcatgatatgattagatagatatggcaaataaaagtgcatgtgttatctaaagtttttttaattagtgattaagctttaattaaaataccaaaataaataagtgtgatgattagctagtcatattcttaagtaaaaaataaataaattatactcttttatataagaaataaataactaatttatcaagatcaattaaattagttaagttaattaattattattaataatatcataaattaaattttattctagaaatactcatagaattaaattgttggagtaataattatatttaatgatataacattacatatatgcaatagataatttctctcaccccgcaaataattgacttatatgatcaataggacaaggaatgcatccaattgcgtgaaaaatgagtaggtgttaacaaattgacaataaagtaagaatatattttaattaaaaaattaataattaatacacttgaaaatgaatcaatgtttaatataattagcacacaaaaaaaatcattggtttcttatataaaaccacaacgaccaaggaggcagtcgtaaaaatgaatgttaaaaaaagtttcttaaacaatcacaatagtattaaacaaaaagtttcacaacaatttatatatgaaaaacagcttggttaatacaatatgtaaaatttattttaattataaaaagtaagtcatattaaaaaccaacttaaatgatgggcaatataatcattttaaggttccatttcagtgggttaattgagctgtttgggtgtcaagattaaacaagtaaaaagaaagaaaaaaggaaaagaaagttataatcaaaagaattcaatatctaaagatctgttgaatgtgtatcaactgtcaattgctagaaggtactacatttgcgagttagtggaggatctagaaatcatcgaatattcaaagctaaaagaattacaatttagaaattcaaaagaaaaaaagttaaataaaataagcaaaatcctgaattatctccaccatgaaccctaaacaaagtagtgagtgatgcttaaaatcatagctatgcctattcctagtctagataaggcctaagtgcttaataatcgtaccttgtttaataaatcaaagggaagttgtgcattttttttgacaatgataacgattgttgcctagctatataacagccatattattcgagggggaaaattatacatacaagccaataagttatacgtctcatatctcccgtatcagaaatcaatgacatgatcagaatattatagtgtaaaaaataaaatgaataatatcatacatccgtaataactatttgggtgtatttaattatttacaagatatcagtgcaatactgttctactatagttcttaaatgttcctcgtcttttgagaatcacagtggcctatacgtactcctgattgatgatactatataattgaacttaggaagatcgatgctggaaataaaaggaacatttattattttatttttttgaaaaataaatgtttaatgaaactagtgtgtatataggtttgctttcatttaaactattaaaattggcttggtggcaagacaacccttaaggactatgagtagttgtaaactagtgattaagtaaaattgatattggaaaaagtaaaaatgcgtaaaaaaaattatttttatcagaatatgtaaaaatatatttctcaacttataatatcattatagtggtgtaaaatcttgatgtattcacatataggaattaatttatttaatgaaaaatttatattttatttttttcatatataaatattttttggattaacaacaattatacagtacaagggggataattcactgatttagttaataggagacatgttatctctaactaggataaaaaaatgagcttatatgtaaactttaaatgtactcctatacaattaaaaaaaatctttgtttaattctttaatcagtatcttaagaatactcactaaaaaaaatctttttttagtagactgatgatgaagtttaacatatgttaaaagcactcaaaagtgtggtttattttataatttttaataaatattttaaaaaacgttatctagatgaatccataaactaacaacttgctaaaacgaattaaagtgatactgaaagcattatctgtatatctatatcgaatagtgacttgatgtctcttatgattttacatatttcgaatgggcttaaattaaacttagaacgatcgagtagtagtttatttgattaacataattgaatgatagtatttgacggtgtcacattctttaacagggcaagttgtataggtgtaatttataaagatgggtgtcgttttcagcataaagccgaagtagtagataggttgcattgcatcatgttcacgtgtgtacgattgggaagtgtgagaagccgcataatgcatagaaaaatatttgatatgttattagacatctagaaaaaagagataaaaaaatgaataaaatttataacatgataagaggtgagaaatgaaaaaaaaaatatttaaaataaaagatgatttgatctaatgcatattgcattgttctctctctctctctctgcaaagtaaaatagaaaatgacccaaaacatcaatcacattatcaaaatcaccaaaactttgaaagtgagagccccaataattgaatatcccccccccccccctcctcttcccccatacttatttcttttaaaattaagaacatatcaatatccaatcaatgttaaaattaaaataaacaaagtattaatttactttcgtgtctctttatatttaaaaataaatgaaaaaggttagagaggataaaggttatatagaaaaagagagtgtgcttgtttctgttagtgaaatgatttattaatatacagttaaaatatccagttagtaaaaaataaaatagtctaaaattgtaaagacgaaagtaaatatcgttatcataatagttataattatagatatggtaaaaactcattttttttttttaagttttgcatgttatagtttaaaatatataatcaaactaatctctaaaaaaagtacaatattaattatgttgatttttaaataacaaaaaaacatgttcaaattttttaagtagacgaagaataagtgaaacatatacttaaaaaatttgaacataattttgatattgattgtgtttatatatctcttactgaaaaattctaataaataaagagaattccaatccgtttagatcagacaaaactgtaagttatatacatttttacaagtatttaatacaattacaagtattccaactcgttcttatttattgggtaacttgttattaagaaagtgaaagtggttatgggattattaaagtaataaaggaagcaatgcaacacgcaaattgacgatagaaggtggctgtggcggtggtttagttgctgtttgcaccgtccaattccaattatgcggtgagtgaggtgagggcaataagggcatgcactctttttcagatctattccttcgtgttctccacgcacctatcaaattgcattccttctccccccaacttgtgcacacaattcctctttaattaattacctagctttcatacaataaataatttccatattaaacaaacaagcttgccttttctagatgcacatctatttctttccattataattgtggttttaaattctaatctatataaaataaataaataataatgttttttaaaattaattttattatcattaatttttagcttatattattaatattataaaatatataaataaaaaataattaatactaaattataaattaaaataaaaattattttataacatattttttcttcttacaccgtgggacagagaaaatattataaaaaatctagggtttgataattacttaaggacctattaattacttaggacttattcgagcgagctactgtggatgtcacgtaattaaaaaatttacttataggtagacactcaaaatactagatgtctagatgatatacttaaagagagagagagaaaaaaaaatgtaaatataatgaataacataatttattaagaaaaaaaatgagtacttcctctttgcaatacttagattccaagaagagagagacaaatagaaagtgatgaaagtgttaatttttttgttatttatttctctctctctctctctctctctctctctctcctactaaaattctataatacaagagagaatacacacacgtgaaatggtgatccattatttgtcacctccgcatgcacgtgactccttttattttctgtaaggtagagataaaaagttggattcttcagtcttttgattagatagagtgtttttattttgaataacaaaaaaacgattatattactttactttattttgtttgcatttcaaaattttatttaaaaatagcatagaaataaaaaaaaatacttttatacattatttatataaccgaagcaaataattatttcctatataaatatttgataataaaaaaaaataaaaggaatattttataatcataagtacaaaataatgaatgaaaaaaaaaaaaaaacattctaccagtagtttggagacctggaaaagttgacaatacacagtctccagcttcttcgttcccctagctagaggttaaatgtactcttacctaacattagttaaattatttgatatatatatatatatatatatatatatatatatatgtcacatcataagtatacatgaaaaataagtgaatgaatcctttagttcgtattcaatgtctcgatttttcaaattaaacttttaattaacttgctaatttctatttattcattataaattaaagagaaaaaaaaggaatggataaaaaaatttcgtaccatcgaacaattttaattctagtacgaaaaaaaaagtaatgaaaagtaaaactacctttgtaacttttaaaaaaaaatcaagatgctggtcaaactcttgttatcactttgatatcgagtcttgcattgacgaagtaaatttgatatcatgaccaacatttaatttgtttatattctaaaaacatataattttagaatgatacacatgcatagtgcattataactcatcataaaaatactaacattcctgctatacgtgtaaatctatttctagatgcttccttcagtcaaattaaggcctaacaggaacccaatcgctgacttttttatttttaaaagtcaacgaattgacaacttgattaaacttagtctattcttaatttttttcatatcatatattaaacaggagggattaacttacaaaataattgttttaaaattatttttattcttatcattaatttttttttaaaatttaataattataataagtcattaatattatcctatagaatctaagaaaataaatgataaaataaaatataattctaaaagaattattattgaaataagttgatcacttcttatattaaacatgcaagaaagataaaattatcatagagaacaatatttcaataaaatataattggttatacttattaatattcatgacagatatttaattattgaaaagaaaaggaatagaggggataataattgtttaaaatgttgaaatcttgttgtgacttgtcagcgataacatgtttgttacagtggacgcaggtgcagcggatccaaatccccttacctcgaacttccaacattaaaattagcgaatcttgtcctatatacgttatccaatgtagttgccttttctagtcagacatatttccctccaactagaacttgctacaacaaaaacaaagcgtacaagattttctggacataaaaataataataatttaaaataagttttaaaattcattgatagttatttattcatatatcaattaagtagttcatccgtttaatattagatttgattctcttctcacttcgacgcaaaaaatatgattgaacaaaatgaattttattaaaaataatcagtaagatttttcgaaaaaaattaattattaacgaaatcaataaataatatgaaacaataaaatattagggtaaaaaaaaagttatttatctatatatttttcttatgagaatccttgaatgattgcatgatagagcaatagccattggtgatgacatggatatatgttaagagtctgaatgtgtttgacatccacaaaaatcttacgtaacctcagcctcccattcatttttcataaataactctgccctttcctttcattgtccatcattttttctctatattgccccacacacagaacaagaacaacaacaggaagaaggaaaaaaaaagagaaagaattctgtgattgcattttcagaggagaggacaataattgaggtgtggtgaagaatttgttggagtgaggggaggtcccacctacccttcacattcattatcttcttcatcagaatctctgtttaatcctcttctctatctatctattctgcatcaccccaaagattgacctttgccttggttccattgtttttgtggatcttgagggtcttatgtgggcctcttgctgcttaagttccaactagctagatctattttattctagctacacaccaattatatatatatatatattcccagaagatttattcacttaccaataagattttgagattctgaacatatatttggttcttattatatagactcatcttccatctttttttccatttttcaattccatttctcggtgttataaaacctgttatcagatcttggttgccccacctccatttcttgctgtgttgatgttcccctcctcataaggaccattgtatacagattcttcattcttcattgaatgacagctgtttagattgactacacggttgtgttgttctctcctctttattggaaaccaataggagatagagatagcattattaagctactgtgaggtttatttccatggttcattcgtgtggttctctacctaatttattctgatctaactttggcctaggaggcctaccattgggtttaggtgggctttcactgaaccaataaaaaaaccatttttaaaaggtgttttgttttgaaggttccaatttgctttctgtgtttctttccaacaaggaagggaggttgtgtcattaatttgtgtcaaagtattttggttttgcttttccccttgttagccattggtgttgcacaattggctttaaggttctattatcacatgccatacttgacctgtgaaagatatcctacttcctaagtgctaatgctactctacttaatcacttgcatctccttctttctggttttaaagcctatcctatctctcaaaccactcccatcatgggcaagtgaagtgaggttgatctcccctttgttttacaaagacttgtctctgaagtccatctctaagttgtttaggaaccacctttggcttggttttctttgtcaaattcccacaagaatgtctctaatgaagaagtcttcaaaggtggagaatattgaggactcccaagatatgtcagtgttggacttgccagagctggtgttagaatgcattcttgaaaagctccctacagcttcactttgtcaaatggccggggtttgccgctccctaagagagagctgtgtgagtgatcacctttgggagaggcacatgaaacagaaatggggtagagttattggtcaagctgcttatagggagtggaaatggcatgttgcttccaaagggaatgttggaactcttagacatggaaagaaaaggagcttgttgaggcttgtatcccttagttggcctttttcatggatgagaaccaaggtagatgcaaataatagcatcaagcagcaaaattatttgcctcctgattcactcatgacttggtatcttgctctggagactggcaatttcaggtttcctgctcaggtctataaccgtgaggtatcaatgattatgaatccctttgtggtttttgctattgaaaacttatattctatcatgctaccttcaatagtaaaacaaattagttttttatggtaactagaatagaagattgttgtgttttctcacaagttacatttttcactgcagaatggccatgttggatttatattatcatgctatgatgctgaacttagctatgatcctcacactgacaccttccaggccaggtaatttaattggacatgattcttggtgattatatgtatgcatgctcccatcagtcattgaaagaagaaatattaaaaattaactcaacccattttcattatattatagttctgtcatccatacacatgttctgtatatacatagacacacaccagaattagaatatatatttcatgttatttgtttaaaagttaaaatttaattcgcagaggtaaattaattttttttatgaatattcttataacaacaattgcaacaattttttttttttttttttttttaactttgatcgtaaaccatacacaattctttcttgattgtaagctatgcttttaatcatactatttttttatttatttttcattttaaataattattaaccataagaaataacacgtgactagagcagtaatgaagattcaaaagaaaaatagaaatggcaaaaggaattgattacaaagctagtgttatcatcatttttttattataaataattcagacagagaatatattttaagagtttccataaagaagaaaaagaggatagatctagtggccttattattgatcaattgtttattacaggtatccaccacatggaagaagggcagttgcagttgagcatggcattccatgggaaaggctaagagaaccacctgttgatactcctccacatgatcttcatatctctgattgtctatatgatttgcatccgggcgatcatgtagagattcagtggagaagaaacaaagaatttccttatggtttgttcctttactcaacatattcttctacttttacagttttttatggtctttagaatatggttaaagagctatttaaacaagcataaaaaaagagtggctatggacagaaaaagaaaaactaggatgaatacaaactgtggggagtaaacacaaagaggaaagtggaatccaatctagaatctgataaaaataattgcttatccaatcttaattgtgcattttcctttacatccatctacccttttctgatagtagattgatgaaatgcacctttatggcaggttggtggtatggtgttgtaggccacttggagttatgcgatgggaatgaaaattactgccgttgtcatagtagtggtgagttaatgcattttccatttaaatgaatgtgttttatcattctttatattttcttggctgtagattttaccttttatgttttatcattcatttaatcaatatgatttttgttcctcccttcaagtttttccatttaaatgaatgtgttttatcatccattatattttcttggctgtagattttaccttttatgttttatcattcatttaatcaatgatttttgttcctcccttcaagttgaattatgttctgagtaaaattgcttagtggacagatgcaaggaggatatgatttagggatgattggaggattcggataaattatgttttcttagattcaactgaatagtttataaatatgcaaaaatggagagagataaaagataatgctccagaattttgaagacacaggattggagtgaaggttgaaatactgtttaacggattaaatattttaaagttttgatatttaccattattatgtttttcattgtggaggtttaatggtgaaaaaagttacataaatgtaaagtttatggcagaccagaccacaatttgggctatgttcctttcctgataatatatcaaaacttggaccaccagctatgatatatgattggtcccctagacatatcatggtccgcatgtcatgattccaccaacacattgataatttgtgtctcagtggatacatttatggccaactacgttaaaatcgaaagaaaaaaatcaatttctcttttatgttctgttttctttttgttatgtaatatggggataccacagtccctataagccttaaaagtttacttcctttttctgatattagtagttatgaccagaataatccacaatctctgcttagctatccggtctgatgtttcatttaacatttccttaaccatagataacaatagcaacagaataataataatgcaaattactaatttgtgcctcagtatcttcctggccattattacacattgcttttggctgttatctttctaaaaggaatttttttgtgcaaaactctattgtcatatttttttcatcactttgtgtcagcatgatgacagtttttacacatgttcctgtctattttttttatggagttgtggaccatgcactcataccatcaaaagctttttgccacgaatattgattattgaatagttataaattctgccaaatggaaaactgaacatgtcaatttttctagtcttggcattaggcttttgtatatttccatttcctttcttaggattcaaacatggtttatttgacactgcattatgtgtttgttggttgcagacacagtggtgctagagttcaatcagtacactcctgactcgcgttggagtaagacaactataagtagaaaagatcatagagaggaaggaaatgaagcagatggtttttatggaggaatcagaaagattaagagtgagaatgagatttccatttggaaaagcatttggccttctgaaatcttggactaatcagatttaattttctacttagcattatgtcaagactagtattcttattaagcattagcagaggcaggttcttctgcattagagacaaaggggtataggattctcatcattcaaaccaaatgagcgtttgaggctacctatttacgttccccttttttattatcacattttttcatggttaagtttagcctgtaatttcaatcaatgtaaattgctcatttatgcactgatggcgtagaatattcattccacaatatatagaatgattaaaatctctgattttctcagattattaagcgttgaaatcacacagcaatacaactttcgtaccaagtgatgtaagaagtatttcaggcattgtttatatgcaaacggatcatcagcaatatgcctaaaaaatgctctctctttgcgctaactgatttttcttttggcaataatttatgattgaggtctctagcctcttcagaatgcagcgctcatgctgattcacctaatctaccattcagtgttttattttcccagaaaaatgaatgtctattcaacaatcgctatgtgcaagaagaaaaaaaggactataaagggaatgaagattgttatagggaaatttatatgccaattcatgtgggaaaatttctagacaaggtataaataaccaatttctaaaaagcattggtatcatatggttcccactagatagtataaaatggcaaagtagaggcaacatcacagcaacactaatagaacgaatttaaaattgtaatttaaagcattcattttagctaacttctacattctacctatttcccttcctcataacccaagcagagaaaaaatcttggcaatggcctgtgacataccaatctcattttggtcaactcacctgttcttgggtctttatcccattgtgttgattctgttgctttcacagatttcatgtcaagtttcctcaccaagggttgtttctcctgtgctgccattttatcttctaacttatgatgagcattggctttccacatgttactagtcccaaagagaaacttctttatattttctctcttcttattccttctccaaaaaccacctcttttcccctcatctttctttgtttccatagcaactttggaaattgaggtcctctccaaggttgtagtatcattgctcactcccactagtctcacctgttttgcaaacatcaaccctttgggctctgatagcacatttattcttcctgacacttgctttaatggctctttcttaagttcacatattagctgagctgtgtcacaacaatgtgactcaagttgacttgactttgatattcccacatttttttcagacttcttgttgaagctcctgaatggagaaagtgatctagtcctcctgagaccatgtcttgcacttggattccctctcttttcttctctgaccttctctaaagccaccatgaagggatcaaagtcatcattccacaaactttgccgcgaaaaccgaagcctaagcaccgatcctggggaccttggagacgacagtgttgggctgtgagtgctcataatgctaccatctccattctgatgcatccttggaggaagtttgagaggtggcatcagtggtaagactttaccatcacagaatagctcatcagcaaatgccatagtctgcaatgaatcaccaaaagggttctcatccttttggtttgtctcggtgtccaagtcaccgacactaacattgaacctgcgactagtttcaaattcaaactcatccacattggagtttacatcatcctcatgtgttgctgctcttggtgttgtggggccagtttgagaaccaaagggtgctcttagtttgagcctgctaggactagttggtgcactgtagaagcacatctcttggctgaaactacatgcactcatgtagcagaattcgttggagaaagagatatccatcatatccaccatgtttgacacagaaaactaaacttaagagacttataatgcaatgacataacacaaggtgtagtgtttttgttaaaaagacaagacaatgatagggagcttgggaaacagctgtagtgtagggattgttgttcctaaaatgaagggatttggattatatatatttgagcaactttgttgtcatccctcaaagtaatcttcaaagttcataggtctaccagaattgaatggatagcttttgtgagggtttttctggtgttctgtccctttctgtgttggccttattaatgctgcatttcataaatgtcaaaggaagttaatgtttattctaagcaacttaattcactatgttttgctgtttatcgtgaccctattgttgtcttatgatttcttaataacaattttgcatcattacgtaccaagcgtataatttatctttgtgaagttctcccccttttaggcatcattgaaacgtataccaaacgatcacattcagcatctcataatatttatatttctttgtacatgcggatgaaatatttatcaattttattgataattaatttttatcataaaataatcattgaatcacttttcttaacttttttttattctttttatctaaaatctgagactttataaaaaaatccaaactcaatttcatacggagtaacataataatattggtcttctatcttatttgttctcctcttacaaactgggtaagaagaagtagcataatgtttactttaagtcatggagaatcaatttagttaaacaaatttaatgcatatttggtcaaggtcctcttacccgtgacattgtacatatctatattgccacaggccacaagaggaaataaatattaatggtgcctttacccattgaccctccttaggagtctatatcccaataaattctgttaccagcgtcatcgcaggcactttgattaggcgtacgtggtaattcaaatttgtaagaaatacataatgcaattttggctcttaggcgtaagataaaattgtaggacgtaaatttacgtgcaacaaattctatattatttaccagaaaggagaagtatattaatagaacaacaagaaagttaaactatttcaatactgtgacaaaatttaaattgtagagtagaggagagtttaagtagttaaaactagggtgcatatatagacttaggttcacggattgggcggataacgattttcttttaagtttgtataattttattgaacttttgagtatgacgtgttagcgggctttatttgtgaactcattaactagactaaatttaatgtgtaaataatattaatttgttagttaagattttgatctctttaattttggttattattgttattttgttatgtttaaaatgtttgtatattttagtatgatagattttaacttaaaaataaaattaattttttattttattttatacatttttcacttttaaaaatatttttataaaaaaatatttttcaattaatatttagattctcaaaccaatccatttattcacggatttttgcaagtagaatacatatcttaaaaaaaagttcatactttgtagatcaaatttatctaactcatcaaaaacacatattttccgagtcttaaacgggttggacttgtccgtacatctatccctaattaaaaccttttaagttggattggtactttctttaaaaagtataaatattatttgagtaatgatattcatacaattatatttacaacaaattatacaacaattaccacatcagaaaaaaaaaaatcaaattttagtaaaaagaaaaacaaatttcctatcttaattgaattgctccatatgtcgggactatgcatagatgagataaaagattggaagtgacaaaaactcaatctagcaccattaaggtgtgggtagtttagttgttttttgtgttttgggtgagtttcaattataaactctcagtgaaaaggtaacgatacttgaattgcagcacatcaaaaggaattttaatggtggatgcctaaacaaatgcatgaaggagatataaatcattgaaggagggggcaagagtgcgggaaggattaggcggtcaatgaaaattaccatgagagattccactagattgtttttatttatttttatcaaatttgatattttttggttgttggatttgtttcttttttaaattaagatttttttttttttgctaacctgttagataagatagggaatttatttttttatttattaaaatttgatttttttttttgtgctaatgtggttgttgttgtataacttattataaatataattgtatgaatatcattactcataatattttaaacatctcgcattatttctaacttttttgagtttcttagctattgtaagtggaattaaagacatgccaccatggttcgtcgtaaaacccacaaattctaaaatatacttatattgatataaagaataaaaattaaaataagtaacctagtcatcattcattaatgtttacaatgcaataaattacaatgataatattttcataattataataaataactaatcttatctatggatgatgaagatgaagaattacttaattttagattatttttttaatagagcttttggagctaaaaaataaaatttaaatttttaaatatatattgcacagtgtacaatatttaaggaattccgtgtagcttttacttgagacctcaaataacctcacaaaacgccagagtttgcacacagcaaacccaaaatccagaaaagtagcaatgtttatgatagtggattgtggagaccaaaaagtcaagcaacaagtcatatgcatctatcgttagagaaagaaattagagaaccacaacaactaattaaagtatgaacacgacagataactgatttagctttcaacattggatgaaaacacaaattgggcgaattgagaggtgaattagatttatgtctttagaagccaacatttagctcgttttatatataaaaagaaaatgttagcaaaatgttgaatcgcaaaactatgcagttatatgataagagtatttttgttcctttttaagtattaatatttatatatttattgtgggataaaattgtaaaagataaaatggacaactttatcactatttgaggaatgagaaaattaagtaagtttttttggttcctacataaaaaatcttaaaaggaaagtaaccgacgtggtctatttgtattttttaagtatcggtatcaacataagaaaattctataagatttgatgtgttctctatccccatggtcagatttatttgtagaaaattatgtgtgatatagtttactgtaaaattatgcgtaatgtactttactaatttctataaaggtgtattttgtccattattcatgtagttttcaaagatctttccgtgaaaaaaagtaagatgattaagggtttatttggatggaaatttttttaaaagtacttttagaagaaaaaagtaagaagaaaaaaatgaaattagttttttcataaattaaaatgaattttttattaactaatttatagatgttatatcatcttttctcgtatattagtaaacttctaaaaattaatcaatgaagaacttatttttacttataaaaaagttcatcttattttttttcttattttctttttctaaaagtgcttttagagaaacttatctaaaaaaaaccctaattcaataaatattgtggagatatttgtaatgctgagatttataagtttgaagttgaaatgaagatggttagattttgaaaatgtttttttttcttatgtaaggattgaaagtattaagatgaactaaatcttgacaaaggaaaatctgactttcttttttttatttttaaaaaaaggcaaatctgaccatttgagacatgaaaaaaaaaattcaaggattatatcttgagccgaactagaactagggaggctggggtcccaaaggcccaattagaggttaaggtccttgtggtgaattacaatgtcacccaaatcacactagcacataagagtaattaatatttgaaaatttaaaaggagttacaatattaaaagtcttaaaaatataaaagttccttataaatagtagctcgttatagtttaattaaattaaaattgtaactgtatatttcaagtgttaatatttatattttttttttacacaaatctctacttttaaataaaaataaattactctttcctctcctgaaagatacaaatattataatactatttcttcttatgtgtttgattgtatacaaattaatttatttaactaaatatcattaaattaattttaattaataaattagagtatctattattatttttgagaaatctacataaaactgtctagctagtttcggaaaattggttggcttcaaattttcgctggaaaagaaaatgaacaaacttcaaaaaaaactattaactcattcttttccgcaaagtagaatattcaaaattatttgctttagttggaactttatgatttttttaatgtttaataaaactagcatgtaagctttcagcttataataaactataagctagagttaaaaagctaaaagttaactcaaaacttacaagttagtggatttaattaaaaatatttgataaagttaactgataatttaatatttttaatatttaaattttatttttaataatttatcatcttaaaaagtaggaaaataatttttaaaattttgttttataaaaaatggtaaaattatttttttccattattttggaaaattaaaattaaattaaattaactttgttagaattacattgtttaaaattatttttttaacatttaaatactttattaataatattattttaaaacaaaaaattaaaaaaattatattttttcttaaacactttttttatctgtacaacaagaacataatattatttaatccctttttgttggaattttattgctatataatggagtacatataattttttttatcaactttgatttagttaccaaatattttaactaataaaaaacaatgtaataattcattaaaataaataatttgacattaaaataaatgagttttttccgacagtgaaaaaaaagataagagagtttttaatttttaatttttaaattaaataaaaggataaaatgaaattttaaacaaaatactaagtataaaaatgagaagaaaaaattaataacttataaactagcttatttttttataaattactttaagtaacttatcaaaaaaattaaattaattaaaaaagcttataaactcctgaaaaaaccttataaactttgcattaacaataaaaaaacaaaaacaaatgtcatacatacatttgtctacattctattatcataacatcagaagtaggacacctaattaaattccaaagatgaatttcgggttcaacttcttgctacggaatagttttataaaaaaaatgaataaattctattattttataaaaactattaaaatgaaataaatacctttgatgcagatataaaacacattttattagtcgtcatacaaagaaaataaattaaataaaaatacaaaatatattcaataattatcattaaaaaataagaagtattatacgaattttttttttttaaagtcagatgtatatattaagaaacagaaaaagccttgagtcaatacatgatcaagaacaatatccacaatttggggaggggtctcctcaatgcaatggaactcattaaacaaaaaggatagcctagccaaagtttcagcaaccctattagcctgcctatttacaagagataaataatgagtggatgtgcttctacgcaaaatagcacaatcccaacacaaaaccatcaaaatagctattaatagggaaagaaagtgttggctaggggcatgcaattactctcatactgaacgttgctaaacagtaaacataagatccgcagataattcaatggcccacctgtagggcaaggcttcagcaaaatgaatatcgtggcaggtggggagaagcatagtagaatctgccagaacaagaatcatagatttaaaaaaaaaaaaaattacctatttcattgttcagatactctatgttatgtgtaaataagaaagatgataatatatataatcttatccttacatatacgaatagactgttagggcaagacacaattttattgtgtcagagttcgtgaaccataaatgcatcgaatttttccttaagaatgccttgcaccgtttcagtccatttgatagtagtcttcggatgattaggtgttttgatccgtaagaatcaaaaacaatatcatacaaatatacaataactcatatttttacttaatcaactgacttagatttctttcacatgcttgtttagatttaattgatgatcaaaattatcatatttttttaactcccggctgcggaatactttttaaattatcatattttatttttattatgttttatcaaaatcttatatataattaaacgtttgcattaaaatatcaaagcgtctgtagtagcacacctgattaaattcaattgatgaattccgggtttaactctccctgcggaatattttttttaaaattatcatattttagttttattatttttaaaaaaatcttatatataaataaatgtttgcatcaaaatattaaaatgtctgtagtggcccattggttaaattcaattatgaatcccgcgttcaactcccgaccggaaaagttctcatctgaatttcaggttcgagttttgtctgttttaaatgaacatgatattcaattttattttattttatttttttaataaatctctgtattttgaacttcaggtgcacccaaaatccaaagcaaaattgactaaaaaagatgagagaattgtgtctaatttcttacctacttggatgaacaagaatcgtatcatattaacaatatatttaaactaattaactaaccataaactatagttatatgaacaaaggtgtaaaagatatagcaggagttgtctgcgtactttattctccttgcatggaaatatatataaaaaaaaggcatacattaacataagctgttaaacattaaacagtcactacaccacaacagctccattaatgccagccaaatgatccatgatgcatcattgcatttcctgtctttatttggcccttgttccaaagagtaaaaaaatagtatatgcacttataattaaaaagtgtacactgtcaatgaattaaactttatttctaatttacttagacagaacaaaaatgaaaaaaaaacctttccactgtctatacataaaagttaaattttattccaaaaacattatggaattggaaacacgttagcgaaaattattttctttgagatgtttcgtggtaacataacttacattcttacatacggttattgacaatacaccagaagaaactggtccatgaaaatatgtcacaaactttcacaagaaaagaaatgggagaaagaacatgtaaagaagtaaaaaactcaaaaaagaaacaaaattatatatacacagattacagagagagcttgaaataaacaaggcaaaaaaaatccttcagaactataaatttccacttatctgttatgcaaaggattaggaccagtgtagattatccttttctcatcaccaagaactgcttcactaccaccttcacctgtgttctgtcgtgattttcctttaaaggggctaagatttgacgaaggctcagttctaaagctttgagattttgcatacccattagcagtagatgatgagattttgaacaagaacagaatcaacagtagaattgagaaacaagcctgactcatcagcctcatgctctcaactaggcacagatcgtgcatggaaaacttatataattggctcaaacccccataaagaaagaaacagattaaactagtagcttcttttggatctgattcaaaaagggtgtcactaaaaatacttggaaacaaaaaataataaagcttagaggaagggaagtaaagtgatactactagttgatttggaggagggtgtgatgtgatggtctgatgtggtggtcctttttggtcagggtgtgattttggcaaacttgtatgcggattggattattttgaattcgatggtgtgagtaaccttgaagtgtgagctctgaaaatgagtagagtcaatgactgtgcatgggggttggtgccttaatgcaaataaatatggtgcagaatgtgtttggatgcctttttaattactacttgggaaacaactatggaccagagagagacagaagagagagcctttgctgcttctgttggagcttgcttaggtgatgttgctgtgtgatcactgcatgagagagagaggtcttgaacttcaatataattgtgtatctgtctatgtcagttcatcaaataaattatatcactaaaaaaaattgatcaaagagaatgtataagttattataaattttttataaataatttcaatttttatagttcaaaaaatataataaatcctatccgtaaattgtttttcttttaacttctataacacaattatccacaaactcaaatataggctattaaagaagaaattgaataaaattttgttaaacttcataacattatcatataacttgtattataaaaagtagacttaattacaccttttaagttttcccactatcaaaattccaatttcacccgtctattttcttcatcaatttgattattccattattataatcatatacttttgcttcatatttaacttgaggtttaatattaacataagaatacaattgaatatcacatcaacatgaatgtgttcacatcatatataatacaataaaacatcatgtcaatatttttattacacatcaaatgttaagttaacacaaactaaaattatataattaaaatagtagaagattaaattttaaaaaaaggagacctaatttgaattttgacgatgtatagtaggcaggctagagtacagtttaacctaaaaatatccattaaaacttgaaaatatgtagaaagagccattaatgaactatataattaattatgttaaactgttatcatatgtggcactcaacgtacgtcattggtttgtattctcaacttgctttaattttaattaattgtgtctccgtgtgccttagctccatatattttcagtaatccatcaagagtaaattttcaagtggggtggaatccactaatcaaccaaaagtgccggagaaataggattttaaccattaaaccaaaatcaattagctagggttcatatgcgactgcaaacaacaaatttacaaaaaggttgtgtactagttgagcatatttgaaggatgatcaaatgctacactagattttaggttttgaaagagtaattcttttgcacggaagaaatctagtaattctcttgcaatttcacaattttttgatcttgctatttagtcttattctagcatattgtatgattcataggtcataagatctctgtgtacttttacaaaacaatctgtcgggattcaagctttttttatttttatttttttcagcctgaacagtggaaaaataataatttggtcaaactggtggggggtttgacaaataagccatggaaatgttaataacgagctcatgaatctttttcttacaaagaatgatgttgtttttactcgctttagaaaaggggaaattaaagttcttggcttttggttgtgaacattttttttaatttgttttactcccatggtggatggccccttggctttatgacaataaaaacttgacaaaatatattggaaaatctactttgtagattacaaacttttgtctttttgttttattttaattgaatgtgatagcatggtttttagtatttcactaggatctaaacatgaatttctgtaatcactatcggaaaatgggaatcgatgaacaagctggagacaggtcattcctttcctgctcctacttcacattccaagaaatagacacaaacatactttaagttatgattcactagaatttatgtagttttctaatcactttatttgagtcttttgactcttgagggtgagatcttgaaataacccgatgaaaaccctgaagtaattaatcaccataatagaatttatggttgaagtagcttattttgttataagctaataatttataagctaccttattttcttaagccagttaaaagtaacggatgaaaataaatattgtttgaaatagttgataagttattagagtggattatcaaaggtgaaagtgatattagcatatatggtaactaattataattgtaacattctcagtattttggttttaattaaataaagaattcaagattcaatgattaagcattacatagcttaccttaaaaagatttcaatatattttgagacgtagagactgtttgagttaaaaaactacaagatagtcaaacaggtgtgatcaacccaaacggaagtgaatcatatctatgtgcattcgaaagtgaaaagtatggaagttgaactagcttgggtacagctacacgttcatatgagtagaattactattcaatcactgctattgtcgtatggaaccaacaataatattatagcaacaataaattaaggccccatgcatccctaactatttaagaaatttacctgaagctagttagctagagataaattcattctaggagccatgaccaattatgaaaccatgtcacttattctaagtagaagcatttgagatcccaattatggtagaggggagccacgagactttgaccggtaaaaaagggaaccaaaagcaaagtaaaaaagaggtcttataattatttgattttgcttgtgcaccaatttatttccttgccttaatgatagtctaatgtactcaacaaatttgtatgatttttttttccttttaatgagaaaaaaaaagtcaaggcttacttaacacgaccagaagatgatcattttagctccctttcttaagttcaactctgagagtggtgggtgtccctcatcatgatgaattagctttgtctttgataatgccataattaagttttgtgagtgttatacagataatctgtgcaacatgcatggtaaatatagaaaactttgtaagcactagtccatgatggcatttggggtgtttaacatgccattgccattgccatttttgttattattagaggatttcgcaggatacgtaggaggatgaatcctcctatgagtgttgccacgagctagcaagcacatgatcacacaatgacacaaagtaaattggtattccaaaaagaccaacacctatgaaagataaaatttcttgaccagcatgcccacaaattaaactggggtaaatgtttctggtgctcttgtaaaatttaacttacctagcttgaagttaccgaaaaaattattttttaaagagctttaaaaaataattatttttcttaaaagtaaaataaacatggcctatatatatacagaagaatagaagaaaacagaaaaggcgcggaccataaaggtaatatactttagtttttttttttattcgagttaatattttataggatcaatttgtgtcatgattttattatagaattgatatattcttcactattttaaggattaatttcatattaaaaagaaaaataaaactattatctcgtatttgttgtattgaaagaatatttagtaactttttattcaaaggccaaattagattaagtaattcttttgggacgaaatggactgtttatttaatttgctatattatcaactgttcaaaatgactatttatatacaacttctgcagtagcacacagataattctagttcttagagttgaattaccgggatcgaatcccgctgcggaaaactgttttgaactttcagttttttttttttaattgctctgacaagtttaaatgtgtgtatttggtattgcatcatcaacatattttttttttttttttttaatatccagatggaagctctcatttatagcttgcacgttttttccttgaattcttccaaacatgatgcatggcttaaaatgctaattgtcatgggtgatctttaacacgcaatataagctgaaatgaaatatagttttaatatcaaagattatgtatatgcattattttggccaatgtttacaaatatcattttgaatgaaattcattatacaaaattgaagtgaaatgacttatatttaaatttttatattctaaaagcaagttactactaaaattctaaattcaacttaaaattgtttcaattcagaaataattttagattcataatcaacttttcaacctaagatcaatcacgtaagcatttatctaaaatcacacaaatgcctaacttaacataatttttagatgatctatgaattacatgtttacaatcacatttggtggccaagaagacactgtaatgatgctagggtgagagggcatcacatgtctcccgtcttgggaaacaattttcagcaaaggcatgcttggtagttgggaccagaatctttgtatgtgggttacatactactgcatattgaaggggattcatgtcagaacatttttgtctcaataaccttaaatttaaacaaacacagacatcaagttattgtttgtttccctcgagaaagacattagaaagaaaatattgtaagtaaggaaaataccaaatttaaggttctttcaataataattccaaaactaggataaggattgaaacttaagattttccctaagaaacttaagatttgttaatttccttttggtttccttcaatcctccattcctttctccttcaacattttccctaagaaacttaagatttgttgggatgatcgagaactcttcaaagccctatagttatgacagtgaattaaaaaatcataagcattacattaatacacgatttgtacatgtgccatagagtcacacccttttgatattaatactcaaaataccataaaatttcctattcaattcttgtgttgagtgttttgtattttgagaatatttcaaaaggtttcagtctcatattagttcatatttttattccagaaattaatatctatactattattatatatccaattttaattacacatcatatgaaaaacccttttatggttaacctaattttttaacacatctctcaacttgaattcaatggctctttgaattctatctttttagttttgttatcttagtttacacggaaaatgacctatcatatcttacgagacttatatatcacatggatcagttctaaaagacaatgttattatcacaatatctagaattttggattgttgtttgagttcaatagtttgtgattttcaactacaattaatcaataataataataataataataataataataataataataataataataataataataataatagtctctaaacaattttttagcaattttgatccctatattttttttttctgttaaacatttttagtctctaatatcacacaaaactgatttttaatgaagtaacatccacattaacaacttagtaatttgttaagtaataaaaaaatttaataggataatacgtaatattttgataaattatatttttaatctttcatttgtttagatatctgctgatgatgtcagactagttaataattaaaaatataatttactaaaaagttacatataattattttgttaaactccgatgatgtgacaaattatgttacatcataaaaaaacattgttatgtgtattaataaaggaaaagtataagaagaaaaacacaaaatattttatttagagattaaaaacaaaattaaaaatatataaggacaaaaacataattaatcaatttgttaatcctggcatcaactttggttagcacattgcatatatataaattttgcaagttctaacatccgcagtagcaaaccttggaaaattctgatattgaatttcttgattctattccaggctgtggaaagttattttatttttattaaatcttttaattactttcaacaagtccttccattttgtgttcaaaatctcgacccagaaaaatgagtttgttgattatatattagaatattgttcaaaacacacccatagtcatgcacttgattgggtaaaatttatgaaaaagatagatttaatactactatttgttactctcttgcatatatcgtgcgttttattttagtctttcaatttatatttttgtttcttataaagtttaaaagtctgtggttgttgatatagtattttaaaatgtatttaacatcatcactaaataatagtaatagatattgtttaaaaataaatttctaaaaaaaatcaacaaaaataatttatgaaaaactaaaaccaaaactaaaaagaaaaaaatacataaaataaataataaatagcaatccataagagttttcttgttacagttttttaatcaaaattacaagaacttttcacgagaaagaattttgttctaagttgaaaatattttcaacatgacgaaatattttcgggttcaattcttcagtaacttgttttgataagaaaatattttgaattcctttataaatagtaattaaaagaacccgtgttgaaattttatttgagattaatttctatatgctgcgagtataaaagatttttatcaattaaaatcatattaataaaacttttaaaataattattataacgaaactttacatatcatgtaaaattttctcatttccattagattcccccgatttttccttgttatttcccaatgctaaattaaacttatgtattataaacattcttttgggaaaaaaggagctagcaaggttaaactagttgaagcgatcccaactgagttataattaacactccaacaaacaccaaatacaacaatcaaatcatgaaatcattaaatatattctaagcaaagaagttgtgaaggagagtaacagtttagggtcatttggtagagataaatttagttttttgaaaatcttaaattaagaatctttgttttccatatatctattttaaaaatagcattccaagaaagaatgttttctgggaattttttttagctaggtttttggttttccacaaaattattctcatgaggaggtgaaatctaactttctgaaagttttttattgcgatacaaatattagattactctcattggattatttaatgtggtaaataatcacactggtaaaaatatcacgttactttattatttccatgaaacttagatatatttccaaaaatattatgactaatcaaataaattttgcttatctttacaattcacgattcttgattcgggcaagaaaaaaaaacttttgttgtacaatgataagctaagcttcaaataagcaacttgcactcgctatatttcttccttcccaaaaccaaaactcatccatgagagtgaacatgttattcctctgctactagcatgcagaactaggaacataatatgtagagtgatcatatgtcaccacttgaagcatattgccacattgatataaatttttatggtaaacttaatagttaatatgatatcttggatgcattacttgtgacacggttcaaggcaatggcagtctttgaagtggatggcctccccaaatggttgctgatgaaatccccagccaacatgagtttttcaagatcaacattggttttgacaccaaggccgttcaacatgtaaacaacatcttcagttgcaacatttcctgaagctcccttagcatatggacacccaccaagaccagcaacagaggaatccactgtgctaatccccatctgtttaaatacaaattaacatcccttaatgattgttgagtgccaaaacaaaacacacaaaaaaatgaaataattttttacacactaaaagacaagcttgtcaaaagtccaagctatttagttgatgacttacttggagggacacaagtatatttgaaagggattgcccatatgtgtcatgaaagtggacagctatcttatctattggaactacagccatcacagccaaaagcataggaactacagttcctgaacaccacaaaatgaatgggaaacaatctaagtacaaggatcatatgccagaaaccaatgacaaatagtaaaatgcaaagcacttagttttacattcatccccaagttctgccaagaattggcattttcaccttataaagttcatacttcaaaaggtctacaagaatagagaatcttgtctaccaacaaaatgaaacaaatccaccaccacaattattgtatcaagcatggatcgaagttcaaaattcatcaaatttgttacctggtgtgccaactccaattgtgtcaccaagggagatttcaaagcaacccatatcatataactctttagcaacatatgccacttttgagggagggattggtccttccactgggcatccagcaacacatgatacatacctatggaatagaaacagaatagtgtgtcagtaaaattaacaacatcaatcattgggactttcatgcgtccaactactagaccttgacctggccactttgtgaaaggtattgctttcccaatacagatattgaagcagacagttatttgatgtaatcttaaaataattaaaaagaaaataaaaggcgtaccctcgaacaggaattgagagttgtttagcagcacgagtaacagctcggaaacgaataaggctctcttcgatgctacagttaatgtttgattttgaaaacgattcagaagctgatgcaaaaatagcaacttctctggcaccagcagccattgcagcttcaaaaccctatgaatgtaacaggtcagagatctgaatgtatgactgcctatttatggttatctagattattctacctttaaattaggggtcagaactggtaatctgatgcctctcaagtcatgtactgcttgcattacatcctttgcatcagccaactataagacaaagaaacattattatttaaaatcagatggaatgcataaggataacaactgttgaagtcattcagaattctataaatggattggattttatccaatgatagtagccattcaaaagcatccatagtaaacaccagttgatccatgagattgagaactaatgtcagatacaagcaacttggagaaattttactctacccatcacttaaaaatcatcaatgtcaagttacaacaaataaggtaaagccattataatacctgtgggacccatttgggagatacaaagcttgtagcctcaataacagataacccggtggaagctagtctatgaatcaattcaatcttcacagatgtaggcacaatgttcttctcattttgtaatccatcccttggaccaacttctactatctttacaaactttggtatactattcagaaactgcatcatagccattgtccaattaaaaattgaaaacatgctagttactagacaaagaaatgtgataaaataaacagacaatagaaagtttaaaatatatcacttaattggaaacacgaggaggcaaggtgtagatagctaagttagtagctgaaaaaacttgaacagagtattgaagattatgcagccactgaattaccttataatccaaaccttgcaaatctttggtatggcattttggactgctttggcaatcagagaatgaatcatcaatcattccaaatttcattgacttcctccctttggtcagagacttttgactgaaggagtcgtctcgggataagtctcttgtttgtcttttccatggaaatgtctctgctgtatactcttcatcatcttcactgcacagagatagaaagatattacggacatagtaggaggtaacagattaaaaactatacaacaacagtgattagaacataaaagagggaaaaaggaggttgaatttgaatgatagatcaataaagtgtatcaagtctctaacttaagttgcaatacttgactcacttgcagctattagatgtgctgcaacttcgtccttcaatccagcagtttcccatgcccaatttatctactctaggacggcaagaaccaaacgagaacctctgaatcctatcaatggtattcatgcttggtaaattgtcaagaccaagtggttcctccaaacttgacatggcgaattggttgggttaaagggagctagcaaaagatgtgagagagtaagtactgtgcatcaaatgagaggcctattttcatctgcacatcatgcttctatttagcttcacataatgatattcaatgggaggttatactcttgtgttaaaattgcaagataaattagttgccttttataaatttcattttccacagatgatgccaagtcatataaaaaacagtgaaagaagaatcataattagttgcaattgatttcagtgagtttgggtgaacatttacataattgattttgaagtgatttgatttatgtttagatgtttttaatataaaagcatactagtagtaaaactcaatataaattctcgattcaacttaaaagctatgtaaaattgtttcaactcaaaattaattctagatccaatctcaacaagaaatcaaacacgggataatttacttaaaatcatgttagctggtatttcaacgtaattctagatggtccaatgttaattcaaacatgcatagacaatgcttgtatgaaaaagtggacacttaaaatcatgttagctactatttcaacgagattctagttcatccaacgtgaatccaaacatacacagacaatgtttgctcacattgtctgagcaaatggaaaatgaggagggaagtgaaatggagttagaaatgttttaattttcaatcctgaactccttgttgctttgtagggggcaaaaaataacttccaacttgctttcgtgctgtaatagggccaggatttgtggttggaatgtaaaggagctgcattccacttacaacctttccgcatttgtgttgattaaagcatgtgtgaagtgattttcattcccccattgtccaccaactcaaataaggatacccagtcaaaaaagtgatcaatcacatataattcatcagccataaggtcataaaaaaattgcttgttctgttctgagtatctcatctcaacatcaaatcaaagcctttttttatctggaagcattgtatcaaatgagaaaatgtagcccttttaagatcataaagataaattgtgcctttgggatttcaaattgctgctgaacacaattgactttaaaaacaaaaagggaactcactgtagaaacttgaaaccaagctccataaatataaataaataaataaacttaaagcaaaaaggcactcaatggaaaacagtcatactcaatgaagagtgcagaaaaagaaaattctattttttttcctatttgaatttgagactttggtgggcaagttcctttaagaggaaagaaaatagagaattggaagcagacagacctggaaaaaggaaaagagttgaggaaaccctagaaattggagaaaatggaaagaggaattaactaggaaggggtaggaagtggagggggtagatgaagaagaagagtaggaacaaagggaaggaaaaggtcattgactttttgtttgataatttgaattcaataaagacagagaaagaggaactggttttcagttggtagataggtgactagttaggtgagtgacacttcaaaataaacataggtgttaatacaacaaagagttacgttgaacttgaaaagaaagagtcatttatagagaaaaaattatgctttgagggtgtgaaaaattgtaggtttaaatataattttattctaactattttacacaattagaaattttgatttgcctattaattttggtttaatatttaattttttctacttttatttcttacaatccgattaattaaattatttttgatggtatcttaaatgaatatattaggtctagaatttaattagaccaaaataaaagaaattaacgtagacaaagttgaagatttgactaaaattatgaattttctaaaataggagaaccaaatgtctcaattttaaaatgaagaaaccaatattgtatattgaacaaaataaagaaaccaaaattgcatttaaaccaaaattttacccagtcattcaatcataactcacaatgtatggtaaatttgttaacttttaaaataattatcttaaagtaattcaaacggaaatgtgtaattaggtaacagtgtaaaactgttttatactattagtacatacatattaaactctaatttatatcaatttaatttaaacatggagttaatgtaaactgttaattccttagttgaaaatcactctagttataactatactaacttataagatgatgtctagggtggatcacttttataaatgattcatcatgcaccacaatttatatctttgaaggaagtcgttgacagatgatataaggggattcgacgatgatggagcgtgatggtagcgataaccataaaaaaggaggtaatgtaggaaggaaagaaggagatgattcgatagagaaaatctatgataacattttacactttaactaaatctaatgattataaattatgctacataatagaccacttacaaaagtggtccaccctagacaccatcaacttataattcagatagatactagaaaattcaataatcttaaataacttagtactattttccaaaaactttttatcatcaccttgtcttagtatgatcggaagttcaactaaatattatttgaagtatcttgaatgaatacgcaatgtctatagttatgacaatagcaactgtgtggtttcaaaaaatacgtgtgaagtggccaataattcagggatcaacacacgtaaaagtgaagcagacgcattggagaacaacccaatcatgcaatccgttggttgctcgatcctaagactttcacaacagtatataattgaagtgaaaaaactatgtaactctttacaaatatgttccaaggcaccgattagcatttgaaattaggttggagtattaatttcacatcccaataaaaaatttctattttatgttcttagacactcgttagcattcatctttttaatacttcctttgctacacttttacatgatgttcaaggttttaggaatgttattaatttgttaatttttttagaaaatattagataatttcttaatatattatttatttttctaattaattactcatttactcttattatacactactctcactaaatattaagagtagtgttgaaaaaaaaacattcaatgatatattagttttgtaaaaccatatttattttgaaacatttttttttaaaacatcaaatattaatataatatagaacgaaagaagtaatatctgacaaatgaaaaattatttgttttagtatgatgagtgtcctttccataaaaatagattctgaattccgtcccactaaaatgatgagacatacataatttggaaatgtttaatgcttttcagattttgtatttgtacgcaaaaaacaagacaggtgcccaaccaccaactaaaccattaataaagatgaagcttcagaccagagcaaagctcaagctcaacactcatttatgccaaatgcaacttacaacaaatatctcactttaaatcaaattcaattttagtcgtcgtggtatttaattactttatgaattgaactatcatagaggttgtgaaagatacattgaaagatgcgtggtaagtgtgaacattgttgcaaggagcaatagtcattgaaagatgcatcatgcatgctactttataaatattaggcttaatgtgaattttagccccttatattttacaattgttttattttaatatattaagttctaaaattttcattgcggttctgtatatttttgaaatgtatgattttgatgttttttcaatattctgttagaaatgatagaattctattaacatttaaattttaaaaagattaaaatgatatatatcaaaaacataaagaattaaaatgaaacgtttaaaatttaatataacgaatcaaaactgctactatcattattttatttttaaaaataaataacttaaaaaattatcatctcctctaatctctttatgatatgaaaaagtataaaaagtaacactatacaaactgaacaacgtcaacatataatctcattgaaacccctgaatattccaaccatgtagggaggttgcaacggagagggcagcgagggcgagagacgaagtggcgaaaggagaatgaactcttatccattgtgattgagaataattggtgaatgaaattattattactattatcaaatgattaaattgaatgaaaaaaataatactaaaaataatatgagattgaatgttgttgttatttgtggtttcagatccattttttctttatttattgattttcaattttcaaataaaaaaagatagtagagatttttagttgttactatattaacttaactattctaaaatttaaaacatgactcactaagtttctaaccaaaaattgaaaaaagatcaaagtgatacatctgaaaacataaaagactaaaataaaacttttaaaacataatataccataatagacccaaaatgatattaaatcatttaaaaataaaaaattagcataacatcaacatttctaacaattgaaaaaaatgatcaaaattatacattttaaaaacataaaggactaaaatgaaacttttaaaatttaatgtattaaagcaaagcaactccaaaacataattgatgaaaaagtaacattaaacctttattacagaactaaaatcccatacattattggataaatcataaatgagacttgagaggctgccaaatttgtgttttacgtagcagcgagcatgcatggcgattcataacttttggtaatatttattttaatcagaataacattattttgtaattattataaaacaatatcatctgaaaataaaacagagaacttattgaaaagataaaataaactaaaacatagaaaccgggcatttttttttttttctggataaccaggtatagaaggaaatgtcgtgtttcttggtgacactaacctatcaactgctagcatgatttaaccaagacaaccgaacttaaaagtgacttaccaataaacgcaaaagaagatatacaactagcatgacatagtggcatattaatgaaatgataggaaatgaaaagtgttaatcttataattatgcataaatggttaaaatcattataattaaatttaatattaacaatccattttaaatgtctagtcaaatttattcttgtattctcatcaatcacctaatacctgtcctactaagctactgaatgcctcaactatcttgagttttcagttgaaatattatcttcctcgggtataagcacaacacaggcattgtagataatagatatattaaaataaacaatcaactctctcgtaaaagtgtgaacatattaaattattaatacaacaaatggtcgctaagagtttaactagtttcccaaatcagtatggttattatttaataatgcttattcatcatcacttgcatgatataactagtctatttaccgcttaaaaaatgatcccaaggtaaaataatctagtacatattaagattttttattttaaaaaaggctaatttatatttattcacaatcataaaataattttataaaaacaaaaaaataatgaaaaactgttcaaaataacttctaattttaatcagatttaacattcttttcaccttttgactatttaaaaaaataaacaattttttttaaagttattattattattattattattattattattattattattattattattattattattattataactgtaacagactttatctgatacgatcacaatcaccgcttataggcaaataaaaacaatgaagttcaaacaatagaaatgaagaaaaaaaggggtggggttaatgggggaagaatactagttcttaataatacaataaaaataaataagtacaaatcaaaatgtcgcagatattaaattataaaatactttgatacagtacaaagaatttatggctgattgtttaatcataagaaatgtcgaaagcatgcgtgattctttagaactctaggatgattttaagaagcttcgagcagcatctaaactcaactcttcattgacctaaaatataatggaaaacataaaataaaacaagaaaaaaaaaattcgacaaatgcaatactaacaaggaaactcagcttctaattatatgtagtatttcattagaaacatgttaattttcttatttttctatattttgttgcaaaacatgtataatgttctcaagtctctgcagttcacaaaattattttcctaatcaatgaaagacaatccttcaggaaagactcgcctaaaaatatagaaaattccattttcatagaaaataatacttttcaggcaaaacttttttagacaatttcacaaaaaatgctttccaagaagataccaagttgtataaaatatatctttcataatatatttgttggaacaatgacttaaatcacaattattttgcacatactagtttcttatggatttgttggaacgccttgcaaaatctctccgcttcttctggacccacctgttggaagattagaaccaatgagctgtgtctcattcaaaggatacttaaatacttgtttaataatcacaggtaaatgtcatgggtcctcaataacatccccatcaaagttatatgcttatacagcagaaatactaaagacataacataaccaccttatctcttttgtcactactgtctgaagagcttgtaatagtttaatttaagatgtaactacagctctcacaaacaggtttacgaaaaagaaaatgcaatagagaggaaaaacctattctagcacagaaatattaataagaatatttctcccttataacaaaaaaaaaacattttccattacattagattagagaatgcttctctcctcatctttacaaaataatcataataaagtacccaaaaaaaactcggcaaaataaaggtccattaaatgaaaatttcaactgggcatggaaatcaagtaaaaggtcactgttgccaagggaaggaagcaatgatgcaaaacaactgatttattgacataccatatgcgactagaaataaaaaaataattttcaataatatgggaaaatagagaatttgggtttaatcaacaaagaaaataataagcaactgatgcataaatggaaaccaaggtatccctccatacgtcaaactcttcttatggaagattaagtcaaaccatctagccattgccattagttttcaattaaaatttcaccatttgagattaaaaggcctactatattcaaacttttgaaggacttaaacaagggtgtaaccaaatttcccataacgtgctacaatgctaattctaaaacaaaattagtatgcatttaataataggtaaatttcagaataccttcctagcagcctccgactttagcttgctccaaaatgaatctgtagatttgaagaattcacacaagcatagcattaatttcaaaagcataattctgtttcttatgagttataacaaaaataattaatcagacagccatataactcatgaactttgatgtgctttctcgaaaactgaagttgataaaaaaaagtcccaaagatagtggtaccccggtaccttgttgattaattccttgcttctcaaaatccttatccctttcatcccatgcatcttgccattcctttacctgcagagacaaatttgttagctaacaataaatatatatgcagacatcaatgcatacaacagattcaagttcagcattaccacctcattctgtgctgacccagatgcaatttgtctggatgatgctgcttctgcctgaaatttaacagttgccaatttggtacttcaatgcattcacaaatatagaattttgtaaattatttaagctaagaaataaaaatcttggattttgcatcatgtatagtttcagagtatgctgtgggcatcagtatctcaagttcagaaactaatatacatgccagtcctccaaatgtgtaaaagcatttaaggtagagaaaaccaattgattcatataaaatgccaatgttgtgcatactacaaatgtaaatggactaaacatgggaaattattccaatcttctttgaatcaaataaaaatcaaaacaagatgagataataattggttctgacaacttcctgggcaaaatcctagcaactgtaaggaattctccataatccaaactgagcacaaaggaagcccagatacagaaaagaaaggtcaagattttgtctctaaattctaaaataggtcaagtagcaagtcccttaacatcattctagcattttccaatcatcaacccacgcatagaacaaaaaaagttaatttatcgtactgatccatcaaaccatagcaagcagagatggctttggatttcagtatgttcaaattgaaaagagaaagaacacacaaaggaaggaggataagctatcttcctaaaaataatattgaaaacactaaataataataagaaaaatacaactaaagatgaaacttgaaagtggaaaacaggagagctttccaatccagacgtttagaagagaaacttcctttaaaaaaaaccatgagaagggacccaggtagaatcataaattgaatacaaccttgtcccatgacaacttcatagagacgaatgtcctcaaacacaaaatcaatccatttcaatcaaatacaccatagatctgcaaacactccatagaatcttatccttactgctcaaacctcctaccaaagcctctaacttcaattcctaggtgaattacccaatttcacaacaggaactgaaaccacatccttacttataaaatccacccaattcatgccaggaccttgttaattaatatctcatactaaaccctactcatatatttatggtaccctaacccagtctgttgcacccacctaaaatttccacatgaattcagacactacagtgcattactctaacactaccaccttaaaccaacataaagcaaaagggtacaattgtatcagagagaagcaatatgtgaattacgaaaatcacaacatgggtgtctgaaaaatcgaaactttaactggcagagaagccagatgcagagtaatagagatccaaaattaaggaaaaggcacagtgttgtaaaccctaaacacagagagaggagaaagagagaagtacagtgtaatcgcgagaacgaacaacggggaagagttggagaaggcgttgaaattcagcttcatccatgttcactgcaaccccttgttgttgttgttgttgttgttgttgttgaaggagaagacttcactgaccaaaaccttctgagaacggagaaacgcaatcactgtaatttgattataatttgatttgacggggtaaaaaagaatatctttaataaattacttaatctaactttattttttgtatttttttacttaatctaattattggtatattacagtctgaatgaattttactaaattaaatgtataattttatactcaaattatgaaaatgaaaacgagaatgtatatgtctatgtcacaagtttttaaaaagtatttttaggtattattattgtctgagaaagctataatttcccttttaccatgttttctaatatttatattcgtactagaagatgggaaactgatatttgtttaatacaaaagtgactttcttttttatttaaattacttttaatttttttataaaaaatactaattttatttaaattattttaaattttaaaaattattctcatgaatattaaaatataataaacatatttttttaaaataaccaaaaataatattctcatcttatactcctaaaaatagcattcctaaaaatataagaaaattccataaaacaaatactcgattttatgtaattaaaattaataatataaattatattatgattagaatttataataaattaatttatctaaattaattttcatattataaatcaaaatatataatttgaaaagtggagttttctttctcttcactttcttatttaaatattcttaatattttttatatataatatttgtttttctcttctcttattccaaagtatacacaccatcttacaataaaatatataaccttattttttggggtcaccaactaattaccttattaatacgttctctaaatacttaattcacaactatatttcaactctttcaataagaatattttaatagaaaaaatattgtcataataatcaataagttggataagtaataattttctttaaaaaaatgcatatctccttgaagacaacataaagttgagcatctgccatctaagtatatcattacaattgccatattacctgtttacacgagtaaggtaaaaaaaaaaaaaaaaaaatagataattttaaaatataatgaaagacatttaagtaatttcaaattatgaatattcataaaatatagatacttgctatccaccctcatcgtgttaaaaattcaatccgtaacggatttcacccaagggtactagtttttttgtcatcgctatatgtggacctactacaccaagcacgagctatacatagtaaatgtttcatccacccaaaatttcataaatgaggattacagctatagctcgtacaatttactatttccagtcttgaagaatgttgacacacttttttaatattgactttgctccttcgttcttctctatctcgtactgatgaagcagctcgtccttgaatccttcattgatggtgccaactgaagggacgtccatggcaaggttcatgacttccagtagacattctgaagctgaaacatgaacctgattttgggcacaagaaatgcagaatatgaaataaaattatcagcaaccaattagattactgaaagaatcaccacttgttaaagatgaacacgcaaagaaaaagtttacaagtctagtccctaaattttggcaattctgtcagttttgtttgttatattttgaaatttaaagtattcccaaaaaaattattttacttcagttttattcccaagtccacttttgctagatatggcaaccaaatgtaatgtgtgtagtaattttcacttagtatttgttgcatttagtattaaagattgggtgaaactaaaataaattactgggcttttattcacctgtctggaccactccaaccttataagttctacatgagaaaaagaaagacacttgtttgcatacaaactgatggcaaatatattagtacatatacaaacacaacaaatttttggaacatgtttcagtaaacatttcataaataacgtttaacaaatatttaaaggaatgcaatgaaaatatacatgattcccagtttaaattgcacttctgactcatggcattataatcaattgtgttgtctattgaagtcaactaatgtgcctagcgttcagatataagattttacaaacttaaaaattaataccaaacaaatgctgattaccttttcagggtttttgactcctataaggcaggggaatctaactgatgaataatgttcaaccaaacaagacagtgacgtggagttatagggttggtttggtggttgaaaggaaaagggaaaaagaagaaattgtggatttgaatcccttccactaacattgtaacaaaaactaacaactaacatttgtcaataaaaaaaaaacaaaacaagacagtgacgtacctgggcaatttttattgtgcttatgcaatgtagtatttttggtgccagagaatgaaatatctgaagaaaaataaagttgattttagatcattcaagaattgaagttattagaagtccaactgaaagtaagcctccattacctcctgaacaaaggaagttgctccagcaagttcgttacttccctgggagtccttcacaacattgtgaagccttgagcaaagttctctgatggatacaaaagctgtagttttgactgcacaaagaaagctttcttaattaagattaatagaaaaaaatggaagggacttcgaaaaatgaaaaatgagccataaagaataccagtccatttatgttcaggtaacaagaatgttgtatacatgtgcgctaagcccttttgcttttcaagaatatcatttatatgtgccacatggatacaagaggttaaacagtcaactattttgttatgtggaacagaaatctcttcaacactgctcaactctgtaaaaaaaaaaaaagtgtatgtcaaaatgcttgtagtcagtagcactgagcagctccgacaggaatcgatgtaacaaggaaagaacaaattattcaagtggctggccatttgaaatagccattgaaaatgcttgtagtcagtagcactgggcagctccgacaggaatcgatgtaacaaggaaagaacaaattagtcaagtggctggccatttgaaatagccattgaacagtaacacaaacaaggagaatcatccatttcatcaagtccctagatactaaggtcatgtttggtttgacaaaacgttttctattttcaaaaatttgtataggaaaaagtgaaagcaaaaaatgaaaataaaaaacaataaaaaatgcttcactttgtgtcctattttcattgatggaacttattctccaacactactacatacagtatatattagaaatggaataggtttaattcaatcccaaaaagttagcttaaggggagaggattgctcaattccggcttctagccatattcctaaccaatgtgggacattttaacaatatcatacaagaaacaacactctttaactatttgtttaatcagcaccaaactaaacaaacttaggctccgttttggggtgatttttagttgtttcaaaattttaaaaaaaaaaaaaaaaatcagttttcagttttagtttttttattctaatttttagtttcaaaataaactcattttgaaagttttcgatcctattataattagtttaagggtgtatttgtgtggtggcgatggtgattacgacactgacaacaacgacggtggcaatgtcggtagtgatggttggcgatggtggtgcccgtggtcatggaggttgttgtggtggcagtgccggtgccagtagtgatggcggctatggtgggggtggtgggaaaggaagggtcacattgtaaaatgtaaggagaatgtacatatttaaaactaaagaccaaattcataaatccgtttttcttggttttgaaatgaatgagtaagtttgaaattgagttaaaaatcatctcagttccatttttgtcaaatgcgttttgttttggaaattgcatttgaaaaccaaaaaccaaaaaaaaccaccccaaacgggcccttagcatgagaaacttcacctcaaaaactgcattaaatgtttcattggtgaccatacagtctcatatgaggaacaaaaactgttgcaagatataaatgaagatccagaatttgtcataacctgatccagcagcatcactggccaaaggtgcttgcccggactttaggggctctgaattgcatagatcaaacaacaagggaaaaaccatattaaagaactctggattccccaaggcttttataacctggaaacatacaaaaaataaactcattatagagtccaatacttatttgggacgtcactgttctgtactcttatagaattagatagttcctaatacttttggtccataacttgttatagattaagttgccacttttctcccttttttattataatttatcttttgcttgaatatttgatgacgttctcaacaaccagtacaagcaggcacaaccttgcaaagctacttatacaaggggcaaagtaaacctgaaggggtcttatatctcaattctaaataacttttgccaatttctagtacaggcaaatttctttcgtacatttactcattcttttctctagacagttctacaaaaaataggccattatcaattcatttcataactgattaacaataacaatgaattatcatgttagttatacagaacatacaataatgtacatatcttcacttgtctcaatggagatggagtaggttttcaaaaagcaagaatgctagttgcttttcaattgaatacttaccctaagggagaaaactttcccaaaattactaaccagcacccactataaattactaacctgttcaagagaggaaagtgctgcttcacgatactttttcccctttctggtgcatgcagatgataccaaattcagaatggcaatggaagatgaggaaccttgagccaaaattgctttatggcaggatgtacatagagcacctactgctagcaatagcatgtctttaccctgccatatgtaataagacaaaacaagcacatgaaacttgagcaatttgtctttgattaatttttcgtaataatttttcctgccacatgtaaaaactttaagtggcactattctcaaccaaagcaaaattcattactttacctcccatagccgaccaggaatttccttcatgagagactgaagcaaaacctcatggtgagaagaaagagattcacccaaaacttcactaagcctgcatatagcctctgcagactgcatgcaaaacagcagaaaataagcaaacatttatacacgaatcatgaaatcaccgagcttctatgaggctatatcaaaataatataaaatgcagaaaagaaggcaagactaacttttcttttacttgcccatgatgatgatgacatgccctcacatataagaaaaacaatttctcctaagtacaagtggagagtgattcgctccccacttgtgtattcttcccatagttcctcaaataggctggagacatttttatcatcttcaaatctgcatgacattttttagttcatgtaaaataagaaatactttcactattcaatatgaagtttagtttgttatatgaacatcattcaataaacacagtttaccttaagtacctttaaaattcagaatcaaatgcctaaaacaatatacatagttttccaacattaaatataaaatccattattggccccacctaagagcttaagcttttagcaagtgtgggtccttgaggctgatgtgaacattcttcgaattaaattataattagagacaagatgtctttggcctgtgctttttccatgaactaagccaaagatctttcacaagagggggatgtgtgagaaatataaaactattctcagccctccacctaactttaaacttttaagagagttggtcaatgaaactgaaagaacttggtgttctccatactaataatttactaaaacaaaggatactataaccagactaaatgggacaaaaacatgtttttttttttttgtcagcaaaaaattatatatatattaatgaaaggtaccagaagtacccaaatagcaaaatgtgatcacataaatttctcagtagccaccattaccaagattagatgttatttcagcaaaatgtgattactaaacatggtaatggtactcagaaactctaaagtgacctagacttggatatttgcaaaatacattcttaagattcttctttttaaattttaatggagcatgaaataatttctgaaactgatgagaatgcaacagtaaagagattagtacatcctttgaattgttacaagagaaattataggaaaaacaaaagaacgaaacaaatcctgcaaattccacaatataacagacaaataaagttgttacataagcatcataatgaactcgaagaagaccacatctacttaaatgtaaaggaatcacccaatgttctccaagaacaataaaagagttctaacagatcatagtagaagatattttgagagagagaaattttagaaagaagtgaaaatgattattggccactgaactttgagttacaaacagtatttataggcttagatagttatgactaactaactcaacataaaactaactcctaactaattcctaactaactgagagtgcagttgaataatgcaactctctgtacaatactctaataaacaacaaacaaatcattctaactgatagtgaatggcagccaatggcaaaagcttctgcttaaatttatgattttggcttgatataatatcgaaatatcggatttttataaaatatccacataataaatcacatcagaaaaaataagaatgttcatgaccttgaaaggaaaacaactggaatgataacggcgtgatatccaccaacaacatctgctgccatagatgaatagctcttcaagagaaatgcacatgcaatttgagaattcttgtcaccagcatgcaaagctgtagtatcttcaataagtttttgtgcttgagaggctggtatatactttaagactttagcacaggcacttgcaaaggcacgtttcgcagcagtacttttttcctccttaacaactggaaacaacaatctcaccaacatatttgcgtatggcttgatgtcaacaccaacactttcaagcaacaaggtaatgaaattagcaacaccaaccctgcacaagcacagaaagaataactaattatagggaagaatattcccaaaaagaaggaataggaaaagcaaaggaatgtaatttttttttattaaaacaagaaagctggagcatcagcgtgataaggatgacaatatattaatacagaaaacactgcaaatatcaaccatctatttatcgtcactaatcctacatgctttttctactaaactcgccctatttgaaccaacataagctccttaaattttcaagggaaaattcaataacaaaatgactcaagacagttcaagcaggaagacaatgcaaaagaaaatgcatgaaatgtgataataagttaataacagacctagtgttaaggcccactccagatcgcactaaatgagcaagccgtgggatcaatgtattcaatgattctgcatcaacaacttttatgcatgaatccagagtctcccacataggagagcctttggctatggagattctcaaactttcaagcttttctgactgtattccaacatttgccgcatgaagctgataaaaagaaaaacataaaaagttagcatatgaataaacaagaattaatggtgaatttgtggaagaattgaatatatcattcaaccaaacctcgacataattgagtgattgatcttctaggcttgataaactttcaagcatgcagcacactaaatcagacatatgtggtcgaattgcagttccagcatgctaaaaggagacacactcagatttaacagcagaataacagcactgttatagtctacttccataataatcaatcattaatcttacacaatcacaatcagataaacaaagtcaaagacaaaccagaaatttcatgacgtataaactaaataactaaaacaaaaagagacaacaaacacatccaaaactgtgaatgctatttaaactttgtaatgtattatatgtgcaggttagcactaatcatgcttaccaggaaatacaatttctacaaacatttggtattctaattagtttttttatttttgggaaagaagtttgaaaaatataagtacaagagaataggataagctgcactccttaaacgattaaacaaagaacatagtaccaaaaaacaatacatcagtaagtgatggacctcccatctaagtgtccaaaaaaataacacctgaaaaatcattggaataatgcacaaagaaaacatatacatcccatgataataaaaaacaacaaacaaaaggaaagataataaaaaacaacaaacaaaaggaaagataataaaacactagagccaagaaaacatatacatccctacaaagttcaataagatttgaactacaaacaactcttgagatgtgaatacacaaatatttacaatccggaggcagaaagataagagagaaacaaaaggaaagtgagtgtatgacacaagttgaaaagctaccgcatagcaagacattcctaacctttgtaagcttcataacaactgcaattgatgccttgcgaacactatcaactttacttagtataccttctgcaagcaaaaaaggcaaaacaatatccattgctttgtgcgcatctgacatatcagttagagagacatcacagagccttgttgtcaaggaagttacagcacggcataatttttcaccagaaattctaacagtttcctttatgtcatccattacacgaaatgttccagaccataatctctttaaatgcttcccaacctgtgggtggtgcaagatgaaataaaaacacacaaaaaagaataaagacatgctgatatgctccacagcttcagatatatcaaaatcaaccagtgctcaggttctagtatatcattaacattgccagttctttttcactttttaactctcctttcagcataatatggtctttctctcgtaaatacactttatgcaaatcagactttattagcacacataagatacacaactggctctgcttaatttttcaagcataagcaacaattagattacaactaaaaagaggaatattgactaactggtttctttaaaggaaatttcatagaaaaggaatacaacgagaacaaaaatcctcctagatcaaacaaaacataccaaacagaattgttcatcaaatataaatagctctctaatccctcttcaaatcaacacttgaaagccccctaaataaacttataaaccatattttataccgacataatgccgtaaacaactcgacaaaaatgggaaggaaaaaacagaaggccagaactggcaccattcttctcctttgacaaacatcacaaacccataacaataaaaatgctaaaattttgctcagatttttacagatagtgcctcaccataacagtgactagggtttttgttgctacatgtaattagttgattacaataattttgaggatttcttttctatcatagaattgatcattgacaattctaagtatgcttatttatactcaagaaaaacaaaagaaatgttaatgacctcatgaaactttcgtccttgaataatgtctgtaagggcaagacatgatgcctcacgtgaccgccaaagcctggatccacattgtactagtaaatcatcaatgatgagatctaaattttcatcgatggttttctttgaatcatccacaagtgacttccatatatgtaccattgcatcctaaacagaaaaaaatgcaataatcaagtgaaataagtgtctgaaaataagaattcatatactcattggatatcatgcataacattgctttttaataaaagaggaattgtttattgaaaaaggcaaaaaaaaataataataatacaaactgcacattatttttttgaaagtttaaaaagaaaaatcttacatggaacacaatagagaaccaaaccacaattttatgcggcaaaactacattttgatgttcgaaaacaacggcatgaattatatagtactattatgttctatcatagatcaaaactgggtagagagtttttctgggttaaactggagatgctattggtaagaattagattcaacaccaggcttaccagattataaataaaaatcggaagcaaaagataataaagtaagtttcattttttaatgttttgactttcaactgaacccataaagaactggagaagcaatgcaaatgctattgtacttgtgtgcatccattccttttctgttttttattggaacaaagcgttaaaccgttatagaaacttggggttgggggcagctgttattctctaccactgattttctggcagtgatggcacttacctgcacatttttgtcaggatcatactggtagcgtacaagccttggaattaaagaacgtaaatatggcttaagaacaacccctgcttgttttgctattttagagaagccaaaagcagcacccctctttgaattcagagaagcttgatagtttgctaaatccatgaacttataaattaagtccggttgtcccatctcatttgccaagctacacaactccttgtaagtgttcagtttccctccactagcactttccccaagagctccatccgtaaatacttcagtatcttcaacaagctgcacaacaaaacttcaggaatgtaattttaaacaacaaaattaaaggaagagagcaaaaaataataaaccatcaagccttatcccacaaaaaacaatttttttttttttttataaaatatgactagactaacaacttactttgatgactcttttccgtttccctgacccagtcaaggtattaaccagtgcattcaccaaattctttttcatagattcatcaccaatgtcatacacaatactcatgccctgagaagccaactcttgcgtgagttcattttgttcagcaagaaggtgagaaaaagcttcctgcatttacatgataattgtaaatcaaatattacaagttacaggattctgctacaaaatagatacagtgtcaagaatatcatataaaacaaatgggtcaatggtgtttctgttccctgaaaaatggacatctttggttttagtccccaacttttaaaaccataagttttcattccctaaagtgttagctttagggactaacttagtgggtatttaaaaaaatagagacaaaaacttatggttttaaaagttgggaattaaacaaaaggtgaccatttttcggagactaaaaacactattaacccaaaataaattataagaatacccaggtaaccaggtttaggaaacattttgtggtttcacaacaagaaaagctccaccacatcaattacaacaacaatttagaatattaacatggaagaacctcagcccagcaaacaaccttgaccaagcactcctgcttgggcaccaaaggttataaactggaatccagataaacacacactcccaccatcataataaaattcagaaaggactcatacgagcacctttaacaaattcagcaagtttaaacaaagccaaaattgttttcttaatgcaaacctgaatttctggaagcattcgctgaatagtaggatgattgccgcagtactttataagtgatactagccaaacagttccagcacatctctcttctttcctgctactatacaaaagaacatcaaagagctttttggtaattgcatctgtcacagaagcgtgataatctccactatattcactttgttcattagtactctgcttagatacagaagcggtcaaatctcccatcaaaaaatttgaagccattgacagtgaagtatagttagttttcagaattatgtcagcattgaaaggaacaccaccccacaaaaaagaaagggcctccccagcagcgaagagaatatcctcaacctgaaatttcagttacataaatgtgacaatttttagtcgctgcaacttataatggaaaaatattaacattaatggacattttagctcaaaagaaaatgaaaaaaaaaaaacttcaattgtttttaatcaagatcaaggcatcccaaaaaccaaaatctggtttttccacaacataaaaaggaaagaaggaaaaaaaaagatggagcaataaattgaaacaggagacaaaaaacaaagaaacatcaaagtaaacatcaatccaacatgaatcacactgataatacgcaaatgatataaaagacgagggagaagctgaattaccttagatcgacagagactgaaaatcaaatttagggccatatctagctgagtagatgatgtttcttttacacatatatgtccaatagatataacaatcttctgtattgctttaatgtcatcacccgagagaagcttgctcaatttatcagataacattatcagaattccatctgcagaattaatcagacacctttataatagatcaacaaatagctcaactctaggtccaaatccaaacaagtacatcagcttattagacttgactttacctgaattagaatcatcaagtggaggtaatgaaatacgtagtccaatatgacctagtgcttgcattgcagcagcagccagcgcagaagtttcagaattaactacatcaaccaggcatctaagtgtattctggagaagtatttctggcatctgcgaagatcattttatatacacaaaattcaaatatatttatagtgaaagcaatgacatgattatacccaacaattaagatttcagtttcatctgatcaaagtatatttcagaaaaggcatttgctcaaagggcagcatgttgatcaagatcaaaatcacaagtcacaattacacatgactcaaagatcatactgataaaactagcattttatgcaaaaggtgtgttaaaccataaaagtataaaatcctaaagcctattgatccaagctaaagcttgtttatagtgttctaatccatttactaattaaaaaaatgcagtaaaattatacttacaggtgttatagacaaataatttgcagttagatatcctattgcgcaaagagctccatgctgagtctcaaacctatcaataaattaattcaacatgagcatatataaaacaggtaaaaagcagcaactctcataaactgacctaaaaaattacagttccaccagtatacaaaccttgatttgtgtgtttggctgaataaggaagtcaattcagacataacatcagggatgggaagagcagaagacacaataccaagtatgcgtgcaatggattcacgagtgtcccaatccacatgacttagtagttgcttaagccatgaaacttttagggcaaaatgtgatgctaccacctataacaatatgtgtcagaaggaacacaatcaagaaagtaatcaaagaactcttacaactgacctctggcatatgtgatccaattataagcaatgccttggaagcattgacatgcaactcaacagagccttcaaatgacatagaatgctcgagaaccaaacagaatgccttcactgatgaaataaattcagatgatccttctaaggatttgttctgctccaactctgactcaaagcacttcaataaaaatttaatcatggccacatatgtatttgaaggaaaaagaaggttctgttctctagtttcactggactccaacaactttggctgttgttgaagaatgtaatccagcatcatacccagtttgggatacttaagaccaacaatttcacttccacttttaagaagacaaagaccttcaagtgccatttctctgtttcaaaccagaaaacaaaacctaatatgatttataagacttcaagttataaaaaacatcatcacttaattacaaaagaaacctaaataattataaagctaaagttacaactcaaagtttatgttataactcaaaaaaaaaaaaagttcaaaaatcatcaacatggaacaaaagtaactatttttatagcaacaaaaaacacattacaggaatcagagtctctgattattaaaaaaaagccatacaatctgaggacatgacaaattcaagaaagatggttattaaaatttaacacatttacaagacaaaatagtctttaaaaactacaactattcatgccacatacattttaatttgcatattatgatgttctgcacatgctttatagaaattatgacatttgatttgccaagaggctcaaacagttatttgatgcaatattgaaagaaatatgtaataaagggttcattatctaattgcacctcctttggaaaacaattttggaaaattatctaaaagcttttaatgaagggcatgcataataaattgacctggagagcttcttttttttttcctcttttgttgataaaataagaaaatcagttgggaggataagggatcttttccaaagtaaaaggaaaaacacaaaaaacaaagaaaaacaccaagcaaagctaaacatttgctcaaaatatctgtaagagaaatccctttaagaagactacatgctttttaactcatcatagcatgtcagttcattgctaaaggaatttgtaaaatacctgatatctaatttagcatctgatgctccaagcatacaaataaaacgacttggacaatgttgaagatcaaacaaagatgttgcccatcttacagcacaaaatcgtacttcactttcctcctgtcatcaccatgcagcatgttactgttcaaaccatatgtcctttaaattttaattagataaaaaaggatattactacatggaaataagaaataaaaggaaaatcaattgtttggagggggaaaaaaataacaaaataaagctaaaaattgcaataaaataattataatagtaacaatttcagaggatttggttatagcaaagatgccaaaaagctatgtggtgttctcaggctgcagttctttggtgtatttggttggagagaaatgcaagaatcttctattgagttcatttggcatcctgtagtttttctagcttctcaaaagggcatgtttagataaacttctccagaagcacttctaagagaagaaaaatgaaatgagcttcttcataagctaaaatcagtttatgcacacgtcaatttgtagaagctgactcatattagcttctctataagaaaatctgagtaaaattgcttgattgacatacacactcatcctagggatatatatacaggtacagaataatacataggaaaaataaatagaagcagcaatttacaacaaagaataattaggcgaataattctaactttgttccctaagttacaataaatctaggcaacttagaaagtggagtaggtttgttatttatgtaacttccaacacaactggaacaaatacgaatacaactatgccatgaacttgctcagcaaggtaatatatctgcatacagtctcctagatacgaggggaaagtcagcatgttttgtcataccacttgagaattttttagcagaagcatctccaaatcttgtaacacggctaatggggctccctgatacacaagacagttaagtacttcagtcaataaaaaatgtgcaatagaaaagagggtcaaatcccaaatcaaccaaaagtccaaaagagatcatgatctgaagtttgtaaacagagtcacaatattatgtttagcctaacacctaaagtcctaaagtttgagagaatttcaaagttatgacattaagttggtgaaagacttaaaaaatatagcacttaaaataaaaggagtctcaagaaaattgtgtttctaccctctaattttatgaaataaaagaattcaactcaaccaacataacaccaatgcaaccataaatttactatatagctttcctaatttgaataaatgacgtaatttttccaagtaatatgtttcatacctccttgaattagtgcaagagacaatagggaaatatcaatacgttgaaatgattattgttagtattatttaattatatttggctaaataagactctgttagaaggaaagaaaataattataaggacaaggaattcattcagatcaaaactaaaagccaaaacaaatcctaaaactagcggtgaacatgggtcaatttgatttgggtttcgtcttctcgaactaaaactgaattgcttcaaggatttcaggtcaagtcggttcaggttgttaccattttccggtcccaacctgaattgatccaacttggctaacttcgggtcacaaaccaaatcagttctcaggttacccatcagaaaacattaaattggaatattggggaaatgaaagagacggtcacagattcacagaacagtcacaaatcggaaaataaataaacagaatttgcatcgactgcattgtaatccatcagcgtaaggaatttcaacggatggagtcaactgagaactggtattgaaagaaacaaagaaagaaaagaaacaaacagcagcatgttgggagatctggagatggaaccatctgcaagtctttgaactaagtagccttcaaactcgccgaccttttgattcttgtcgtcaatggacaatggtggtagcgtagcggattggtagggaaaattaggggcggagcgtgtgggatcgaccatgtttgagtctgatgacattgtccctagcttggaattgaggaatcgaagcaaggtttggtaaccgtcgtgggctgtttatcgccgaagaaggaaacgcccaggtttgcttctgctgttagggcacgcaacgaagtgaaacaaaatacgaaaacactcattcactgactcactgtctcatactaaataaaataaacatgtacacataacttgggtcgggtccggtctaggatttgcaaacataaacatgttgcctgacttgacttgttcaagttgcttcttttgaaatccgaattgaaccacgagtttggtcaaaccaagttgtttaggttcgaatcaagtcgggttaatcaggttgttcaaacccatgtttaccgctacctaaaacataagttcattggttcatcgtagttatccaatctaatgtattaattttaattaacatgtgatgatcaaaaggggggttaaatcatggaacattttcctccgaaagagatggattatgttgaatataatggcagctaatcttgggctcaactttgggtgtccaatgacttataatttcttatagcatacacttgtgaaggtgcaacaagcaattttacagtacaatgagcaatgcatctcaatttactttccttacatctttgaatttcatgaaaatggagggtataattttgaggcattgaaaataggggaagcaattgtatactttttatttgtcaaaatatctatatgtcatgatatgatgtatcttgtatatgcaagtgaggtaaacataactgtgtgactaaacttgacaaactagtttcactttcacatcagatagtcatatactcaatacattttccatgacggagaatattaatgaaaaatagatttacacaagtggcagaaagaggtacatactttgtatgctgaagcaagagatatagttgcctcttgaacaacaaatcgaagagactgggattcatctttcaaggcatgaaaaagacgagcagcaatgtcaatcttttccctggaagaacagggagcagctaaattagtaactgcttaatagaactcagaaaggacctaactcatgaaaagaaattttcttttattaaagagaattatttgttacctgaaaaaagggaaatacataaaataaaataaaataaaaaatcaaatagcaaaccatcctaaaacaatgcaaatttaaaagggataaaaaaagaaagaattaaatagagagctatccaatccctttttgaaaccatagaagaaacatctctaaagaaaacatttacagacagtcccaaggaaacaaagaagacagctctatctcataatgtaatacacagatcgggagaaagagccttgtgatgcctacaagtctacaacagtgagaattattaattctatagtgtatcactgtccaaacaagagagttcacaatcgcattgcagaaagatctaatgataacttatgaatagttagattttgaaacatatattgaaagaatgaaataacaagctatggaggaactagttaccaaactggatggataactacagccctcaaccattattatttttcctataactttaagcatttactcaatgcttttatttaaaaatccaatgagctaacagggagaagttgctttcatatcccacacatttttacactccatcaaattccaactcactttctctagaaagcttcctctttcttctctttgttccatctgagaaaagcttcccctacaatacatcacccaaactcttctctttcactctttgtattttctctattgaaattcagtgctttcatttcttcctaatacccattattctactttcccacaaaatggggttcacagtttagtttgaatcattctttcaattttacatgcttgcctcttctgttgtaaagtaatatgtatattttcttcagttctcagagtagtgtaggcttggtatgtgactcgatccatagaacactgttaaaggtaagtttgacaaagaaaacaagtaaatagttttttttttttttttgctaaacttgttttcatgttttattttagtacattaaatggcacaattgtcaatatcctttgaaggcacaagggctatcagcctcatttttaaccttcctaaaaatatattataaattgttcattactttatttcaaatgttctgcaccattcagcactttcaaacatatttttggtcccatccgcacaaataagtaccaattaaaagggggggaaatatgcaaaaatggctaaaattatgaccatgagaaataaagagattggaacctgaagaggtgaggcaggcgctgtgcaattaatccaattgcctgaaatgcataagttttgacctcccgagcactggcatctgagtcaatacttaaaattaaatgtaaaataaactaattttattcaaataacattaaaaagaactttcaagtctttagcaaacctgcttctgaacttggatagttgtcgagggatttcataattccactcaaaataacaggacccattaacttaagctgatcaatttttgcctgcatttccagttacagatattaaagatgctaaggaaacaataagttatactacttcagtaaaaaacaaaaaatcatagtaaaacatgcaactgccaaagtatacatatatatgggacaaaggaggacatgacatcatttgcaatgcatcttaaattcttactaggtatatgtggtagttgatctttaagtcgattcatcatatagaggtggcattcttaagcaaaataattcaatcaaaagaaaaacaaagatttaaagccaggataagaccttttatatcatggtgaagttaacattcatgtacaaatatgcctttaaaaaaaaaaaggttcatttacaatattttaacaagaatatataggtcatgaaccaacaatctcaaatcccacctaatgcaagagcctattgggcttaaacatgaacaatgcacctgctctaccctatgctaaaatttaactttaatttagaagaacagggacaacaaggcttgaactctagaccacaaggtcataggagctccaataccaacgcacgaatcaacaatcccaaaatgcttaaactgttgggcgaaagcatataaatggtttttatgtctagcaacattatccattctacctctggtatgaaaccataaaaatttaacccacaatgtgaatatataactacatacataattgagccaatagtttatttttacatttctgccacatcagccaatagtgaagtaaaaccacatacaaaaaagctaatctagatatagaaatagaattcaccaaagtaaaattcatttcaaaccggcaattcattgcaaatttcaagcagcattttcaactgaaccacttttaaaaaaattatcttttagtagactttattttcatttaaattgaaacatttttaaagaaggaaggacaaacacttcagcacgatattaatgttcgtgtgttgtgtcagacacatatttgtacaactttttcttttatttttaaactttcacaccaataaagatgaaaacaccgtagttattagataaattgtagcattttattatatctacaatgacttctacaattatgcatgcttatttttaaaacatcaattctcttttttgatttaagatttgggtcattttatgttaatttgacataaattttatactttgcattatgataaccatagcatgttctatgattttaaaatgttatatctctatgccagtgtgatatatccatgtcctatgttgtaaccatagtttctagtttccaaacaattactaggccaagagacttttattctatgggtaaaatttatgacaaaaaacaaacgccaagaaatattgcacttacatgcttaaatacccaaacagtgaattccattcctaattgcttcaaccttgatgtggtaccgttccctattaaattcaagaatatgacaaatcaaagataaaaactgaaaaacaaaatagaacagtagaaaaaagacagagcaaaataaaatctgcacagacaacccaattatcgatccacacgttcgtatgtctcatattttgatattttgataatgaaataagaactttgtttagaacaacaagggaaaattgcaatttctaaacctatatgaaagggaagaaactttgttaatatgaaagaagcattataaacaataaaataaaaatataaaattcctatttgttattaaaatttacaaaggaagattgcatagtctataattggtacaaagttataacttataatccattttccaccttcagtgttcattccatgatttagttaagggtataccattgttgaagattagagaaattgggggcttcattagcatgatttatgtttgcacgggatcattgaatagattgtttaaatcaaagaaacaatattatcacaaaagaaatattatctcatcactttttttatttccatctttaagggtttgcacattctcattttctatatcttgattatcttctcctttctcataatagaatctatttccacaaactaacaaaaagaggaaaaaaaaaaaatcaaacaacctcaaataaaactataaaagtaatacaagttgtaagattagatatcatatatacaaaaatcatagacacagtaggccaagccatgaaattgttaatacaaatggacaagtctcgtaactatagtgcatgtgtcatggatgaatataaaatcttaactacattggccaattcttaagcaacaaaatggcctacaagttttgaagagggtgaaaaaatattagaaaatatgagctcaaaatcattaaataaaagaatattatactaccataaatgcaaccaaaaatgcactgcaaggtggatgggaaattgtttgctgctgcaatagatctgcagaatatagacattaattttgcctttaaagcaggactcccgggactcactcttgattctgaatcaatatgttcaactccaacagtacctacattcaacgtcaataatgtataaatattgaagagaaaacaaagaaatatataaaagccaaattgggttttagacataatagggcagaaaaatgaatacactttcaagatatagtaagagttctctgaaaatagaaaatgaaagtcacgcaaaatggacataaaaataacacaataaatgtctagtattgctatcaaaaacataaacacaccacaataggctatgacctgggacaaaaaaaccactaataccatcaaaaattacaatgatgtcatcctctataattattattttcatcaaaaattactcacctgtcttgggggttttaggtccatcctttctatggcaccttaattcatgtcttctatgtattagattgccataggctggttttgttatcatggactgtttctgttttcatatatttgtatctatccttttttctcatttatataatatatacttttaccgataaaaaaaaatatatattttcatagtagattaaaaaaataggaaaatgtagtgaattataatctctagataattttaaaaaatcataaccatgaacaaaagcagttaccttttgtcccattttatctctccaaattttcagaaagacttgttagcacacaaaaagaggactgaaagtgatgtgactcctcatatagtgtatgttaaagaccaactctcctaatagcttaagttgttaggtggacaactaagaattagaatggtcttatatttttcacaccttcacgcaagagcataaacaatgcataggccctttagcctttgtgttgaaatagccttaattatgaaaaatgggggagcagcaagtaatagagcattgaagatcaccgagagggcacagttcaaacttcaaacatgaaggatgagcacaaaaagttgcccagaagacacatgacattaattaattgaaatgtgaaaaataataggaagttaggaacaacctcatttgaatcaattatactcttgagcagacaaatattaaaagctaatttatgtaagaatcatgcaggctcaaatctaagattcaggtgaaactttcacctatttgcatatgatcgtgaacaaaattaagaaaaaatcaatttgcaaaaacatatttctgtatatgttaacacaatcattaataacataccattaaatagcaaaaataatctgttgatcagattcaaatcatctaaattagcaccattggccttcttctttagaagctcctcgcctctcttaataacaggctcttcacttgagttaattgatcaagcaacacatgtgatcatccacaaatgaaacaccaaaaggatataaaatcagtaagttaataagaaagtgttaaaaatgatttgagcaacacgggaactacaacataccaatctacagaggcagcaatatataaaggataaacaagctcagaggcaagctccatagcttgaatgacattcaaaatacccaactgcaccaacaaagaacaaaataagacagattaagtagctttctgagtaaatgcaagattggacatgattgtatgcgttcaaacatggaaataggacatgattgtatgcgttcaaacatggaaatactgacatgttaactagtgtattcaaatgaaaatttggaaaggtcatatgggtcagagtagaatagttaatctttagtctcagtcagttatgggtcagagtaaaatagttgatctctagtctctgtcggttgcagtagttaacggttgcttggttggttatcaaaacaactatactagcttagcatgtccgttatgaaagtgagctccaggtctcatttatttgtattacaatcatctagtatcatgacttgtatataaatatcatataatcagtatattcagaacaacacaataatatcaggttctgattctctctgaatattttatttctcttcctgcattttctaacaatcttcaaattctacgggaaaaaagtaaatagcatatcatattgagatgagggattcttgaattagacagtgtttcttctgacaagagaagaaatgtgaaggaagatacatagcagtagtagagggagttatcagtttttagaactaaagaaacaacatcaacaacatatattattcaaccttcacatggcaagataatattaaaaccattacatgattaacttacctttcttagtaaaatttcattactttgcaattgttgtttccccgtaacacgattgacttgagctactgaaagcccaggagggaatccaccactgcaacagaacaaaatctataaatagagttctaaagagagagagagagaatctgagacaaaatctttgtgaaaataaaactgagttttcactttctattcttatcttagatatggattcagagtattctgattcttatgtatacaatatttaactttgttcaacaaacttcttactcactgacagttacagcaactaccaacattccaccagaacacgaacagattaacttatgaacattctagattgcaatttacaatgaagagcaactagtaacaggaacatgcgcataaacaaaggcacatactatatactctatcaaacttccatttgattgaaataggaatttaaaagactaactagtgttagaacaaattcaaatatcataagctccgtttagcataaatccagttccatacatttgagagacccgctggtacaatattgtatgaagacaaaactcaataaacagctccctatcttgagaattgttcacttttttatactttgcagcaacttcatcaccaatttgaccagagtggcattcaccaattacctagaaggaagcagaaatccataagtagtcatttcctgaagatttataactgagggtgatctttgctattcaataggatagtgaaaggaagaacaaaagaacaactaagatatacacaatgaaaatagaccaagaaatttccttttaaaaaaggatgctggacagaagcccatggattcaagaaatccaagttctcttaagtgttggtagtagacccttcttcccatcaaaaaatccttttatttcaattcccaagcaaaaaaacttagaacttccctctaatttttcctttttatatccttcccaattcccttgaaagaaatttctccaaaactgaagccttacttggatagaataaggagaaaaagggtcccaatgcactgaacaattaatattaccaactcaaaaactgtgtaccatgaaaatgatcaatgaaaagtcttctacgactgtactcttaagttataaccgtgacaatggaagatttggtcaaagttaaatagtggatgttgataccttaacaacgattctaaggataatttcctggtgttgaagtggaagttttgagatgttcaccaagagatcaggagccagatcttccttttcctattcaaaatgcatggtacgtcagatagtatccacaataagcattcaatagcagaaaacaaaattcttcaaagagtcccaaaccaatcaatttatctatttatccgacaacaaaacataatttacttttgaaaatttaaacaactgctgaaaaaagaattatcagcatcaaaattgactttaaagccacaaaataataataacaaacagcactaagatataaagaacgagaagagacctttgcattaacacgctgaaaagccatctctatatacacaatgcagaaattccttatgatagggacagcagcagattccgaatacaatttccacaagtcagacaaaggtagaccaatttgaggctggagcttcactctcttgttcacgtgactcaaaatctcgagcacctgtcagaaacacaagtcaacaatcatgaaaaattcaccaaatcgcttcacaatatcacatcaaagaggatgaaatagaccgtgcaaaacagttgtacatgtacgcaaactcaagtgtaacacaatcttactatgccaaaccaaagttactcagtaaacactaaacagcaatagtttctatcggttcattaagcaaccacaacagcagagaggagttatttcatctagccgataaagtttgcatcaaaacacaacgaatttccgcactcgcacagtttgatgacaaatttgcatcaaagagtacatgcacgcaaactcttcgttattattcttacaagcgcaacaaatcttactatgccaaagcaaaattactctcactaaacagcgatagtttatatcgattcacacagcaaccgcaacagcagatgagagatattttcaattttcatgtaaccaattacatatgcataaccaaaacacgacgaatttacgcattgagagtttgattcggaaatggaatgtgagacagatgatgaccttgttgcgaacggcgagggattgcgaggagagagaggagatgcagagagggagaagcttggagagcagcggctccagcttggaatcgtcgcagagagccaaacgagtcagcatccgatccagcatttcttctacctccgcgtcagacttcgccaacgacgacgacgatgattcagccatttttcttttctctgtgatacctttcttcgccaacaaactcaaaactcttatttgttgtgctcttaaatatgaattagaaagagtcgctgcttgccctctacgactgctttctactcttgcttcgtagtaggactagtcgctcttctctactacctcttcttcaagtcacccctaggcccaattcggaagagaattccaactaggccaatctcaattcagaacttctctatcaaaaaaactatatttttttaataaaaactctgtcaaaaatacttatgatttaaataagattaatttatttactgaaataagtatttattttaataaaataagtgatttttagttttttgtatatttatgtaaattatttatactaaaaaatagtttttgcttattttaagaagcaaattttcttcatttcttaaaaaatacttatataaaaagtatttattttaaagttgatttttaagtttaaataaagtcaccctaataggcctttatttgcatttataatctataaactctagggtttgttttattttggggttgaatatgtatttggaaactatttttttttcaaattttatttttaatccttaaacaacaatgaccaattttaatttctttggacaacattttttttgtccttgacaacaagtatgactaagcttttgtttggtaaagtaggattaaatggaattgagaataaatatttaacttaaaagtggtagtgaagttgtgagactcactaatttaaaaactttttccttcaatttcatgcttccaaacgaaaggtaagagctatgatatagtaatgtcattgacaattacataaattgtcatgtcatcaattagtttaacatgacattcacttttttacctctcaacattttttctaggtcttaattctctcatctttttatgtaattcaactttagtacctaagataatttttttatcaatgttagtttttaaccattttttgtcattgtttttagttgtgttcatcaagtataacctttgagtgaatgagtaattatacgaaacatatggactcgtaatatagattactagtttaatgtaacaatcacactattaaatgttgttagtttgagacattttttagcaatgataagacacaacaagttttttgatgcaccaaacaaaatcatcaacccttaatatacaaaatcaacaatccactaaagcataatttaaaattcaaatcgataacttgtgataagaaaaatcacaaatcactgaaccatgaatcagaaccccaatctccaaattttttcaaacctcaatcctaaaattttatactaagtttagtgttaacttgttttttccaccataattttccctaattgaaataatttttattttaattaccaaacatcctacttttgagttaaacttggtttgacttgactcaccatctacaagatactaaacacgcaaagagattaaaaaataaagtgtttatggtctaaaacaatattttagagattaaaaaaatctaatttatgtttgtttacaattttaaaattcagtttctttaaataaacaattttttatgagaaataacttaaaatagcttttgaatttagtcaaagttggtattctttttcaacttctaattattttaaaaagttgaaataaatacctaaatattaaaataaaatatttttaaaagtttaaatatgtttttgtccctaataaatgatcaaatttttgtttggtcttttcttcatttttttgttcataacattagtgttctcttaacattggtaatgttttaaattttgaaataattaaaattttgaaataattaatccaatgacggctaaaaatggaaactatcttttattttataatgaaaatcatggtgttgctaagaaacggattacaaccaaaagccccaacccaaatggcaatccccttgacaacctccatgccaggaatcaaaggggcatgccttggctcaacaatcttatcagaggacaaagcattccccaagatgtgtagcatcccaatctcacccaagggtgttttttgcatatgcttgcatcttcttcaaacaacaaaaaccatatctagattatttttatgtcaaacccaagcctaaccctaaccccaacagatctgagacaaatgaaggctcatattcatgcagtgttttgcaaacgaaacccaatctcacaaacacacacaagtgggcttggtggtggttcattgtttaagaatgcataaagtggtgatgattttgcatgggaatcgtactcttcatcacccttcaagctctttgtcgttcctccacttcctttcgccatgatctagatatgattcagatatgaaatttaagaggcgaatctcgtgtgatgatattgttactcctcctcatctccaaagatgataacgtcggttgggacaaatttggtgggacagagcatatgtgtaccaacaacaattttgaaccacttggttgtggtggcggcgaccattgtcattgaagcgtcgtcgttgggcatgacaaagacactgacaagctccattgcatacatgtattaatggtggttcaagtgagggaagagtggaaagaaaaatgtgttgttggggaacaccggaagtgaagagtaaaaaacaatgttgttattcattatcattgagactattcttcttttagtttttatacacatttgattcttatgaccagccctaaatttagtatgtgtttgaaaaattattctctctcaacccaaagatatagattactcgcttctctgttttccattacaaattcacaatccatcaaaatatttttataggaaatgtttgtttgtgcgacaaatgaacacaaaaatactaatgtttataactttagacttaatgtttgcaaaaagagtaaaatataataattataacacataggaaatgtctgtatgtacatttagtggcaaaataaaatcctaaatttggatgcaagtgcattttatattataaatttaataaaaaaaactaattaaactgtataacacaatacaagaatgttaaaatttgtagtataagtgaagtaagcttacttaaaaaacattaaacaatggtgttttaaagttaagagaagcctagaatattaagaactccaaaatcttaaaaaaaatcaagcctaaagaaattagccagagaagtcaagaaagttgagaaaaaataagtttatgccgctacacgtgctttcacataccctgacataaaatataatcacgtgaatttacatgaaagtatcatatgtcatggcatcatacttgatatgggtaggtgccgacattattaatgatttagtgatttttttatagtgctaataaacaaaacataaccaattagggcctatataaatacaagttagaagagattttgaaactttattgaaaatatagttttatctcagaaaaaacctttcaaaaacacttccttatattcaaacagatttctagttacttttagttatctcaataattacaacctccaaccaattccctcaatatgtctcattttatcctttcctcaggcaccatgtattttgtctttactaaacttcaccactcttgaagttgccagcaacaatagaaaaaggaggggggaaaactcgagaatagataaagggacaagcaatgtatatatgatctaataaatggaaactcatatagcaataaaggattgtaattaaattgttacattattttagtttacagcaataacatatggtatatcctagctcacaattcaactcaaaaccccactgtctcactcacacccaataaaaaaatagataaaataatagtagcatatatctatatataattaaaaaataatataaaacaaatctcaactcattaaaaccagaaaagtagtattcctagtaagacaatgtgaagttgtgcatacattgagattgaaatagaactagatttctgtttgtcactatcactagctttgtcatcatcactttcttctttggggtgactgaaattagaaggaacaatagtgtctggtgctgattcatcatctccagcaacaggactagcaggagatggtgcatcttctggggatttaagactctttggcaacccttgtccataggtcacatttattttgaagtgttgtccactcttgcattggtcaccatcataatcacctgagaagaagtatgtcatcccttccttcaccaaaggaactgccactgtcacaggatgtgtttgggtgttggatggatcagctgctgaccattgggttgtgtccttgtcttgtgcatcatcataatcacattctttgtatgtagtgaaattgtatgtttgaatcactgagtggttagtgtccgtgttgaaaactgcatcaacaatacccaaaaatcaaaagttgttaggtaagattatttgatgtcataatagagcatgatagagaaaattgtatgagtaatatatgtaaccatatagtaaagtatctgtattttaatcaatcagaaatgttaaagataattactccatttgctatacacatttcatattcttagattattctttaatataaaactatttttatttctttcatgaatatttaaaatgtaattatttttattttaaaaaataaaaatagacacaaagtgtaatttctctctttcaactaatatataataattttgacgactcttataataatatatcttaaaagtcttaaaagataattttttgattgtttaatagtttaaaatttgttacaccgacaacatatagaaattatactcaaattgtattggaagatgcttgcaagaattacaacctactttcaaagcatgttattgttaggtgaaaataggatatcataaatattaataccaaacagccaacaacacctccatgttcaaagtattcaataggattatgagtagaaaaattaataatagacggcaactgtaaaaacattggcatggtctattgttcaaagaattacctacttttctgtccaactgaatgctcccctgctacacgtggaaatggtttattctaagtgtttggttcaagtcaatgtttctttttcttaatttatgcttcataaaacgtatgactttattaaatgatagcataatcatcgccaattataagtgtaatggtttatggttagcttcaatttgactaatagctataaagcaagtccctttcctcactttttccttcgtctcagaatattattattacaagttttacataaaagaaaaattaaactagtagaattgagtggccactcaatcagagtatcagaacagaatatttgtaccaaaagaaaagaataataaaaagtactactagtagttgtcacaagtcattttgggtatcggatttttcttttttcccttctacccaaaaagggacaaatggtaactaacagtaatattctttgttagctattgtgttgcgtcaaatggaagggtgaatactttagatgagactaacggttgtggttcgtgtggcagactccataaaaataccaacaagagtagtgatgctttctcttaggtcatctccaatgcagtatcttaggagagtttcttagctgacctggtagttgagcatcttatataagcaactgtatcttaaaaaaggatccaccaaaagtcagtaagaaacccatataagcttctaacattggaggtgcccttagtacttccaatttaagcctaactttttctaaatcgactaacattaatatattaagaatatggcacaacgtacccaaaaaacagcatatatgctgcagagggaaacaacccacaatagtactatgattgaagccaacctattttttgtgacactcaaaagtatgttatgctaaaacaaattccaaaataaaaatataagtaaatgatatagttttgcttctcctccatcatacagtgacgggtagagaaattgtgaagagaaaatagatactttgattgctttaaaagcaaagataaaaaaaaaaaattaaaaaaaaaaaaacattgaaaagttatggaatgagtgatgtaatatgatctgtctttgcaatccagtattttttctaaatctgattagacatcatagtagtgttgagtttcagccaaataaaaccagataaatgcaaattggacatcagatcaaggaaatgaaacaagaacaaccatgccataagaaattggctaaaaacattgacaaaaggccaaaacattaacaaaaggccaaaacattaacaacaataaaattcctcaagctctacttagccacttctttcgaagacaacaacaaaacacacaaacaaggattgtaagcagaaaaacttgcatgatgaagaaacttactgaggaaatctcctaagctgaattctttactgtcagcccacttctggtaattgacattggacttttcagtattgtcaaaccatcctaaagagtcaccaactgtgtaattcttgtaggcctcagcagatcctgagagacagaaaaaaaggaagagaagacaaggaacaattgagaacataggacgaaaagagcttattcttcttccctgttccattcttcctggggtttgtgaaaatgtatgaagcacagtgaaactggtttttaataacaagcttaagagaataagaatgtgggattcttgtgctgccagagtggttatgaagccctgactttctgctgaattactaaaatactcactgctctatcttgctctcaataatttgtgtcatagaagtatagttgttttctttgcatctttttcaatacatttaatttagtttttctgttcaactggatcccaaaaaaatagccatgtgatagttgacacgtggaatgagccaaaacggtgggtcggtgacatatcttggttagatgtctcattcattattataaactttggatataataagtgatgcttttagaatatcaaggaataaataaagggaaaactcctaatcgttcatatcttatcttcgtaggacatttctattttgattgttcttttaaaataataggccgaaatattgacaaaactagagcattttatctactgtacttctaaaggatgatccgtttaatttgttaaaaaatttataaaacattccaaacaaactaacatataatattcgattgttttgtaaatgacttaattattcttattcaaaatttattctcttcatgatgacttacttttagttagaattgagccgttccgtaagtcaattcagtatttttaacttgccttaatttgtctttagagtttagagtaatagtgactgaacattattgaagttttccttacttgtcaagattggtacgagttgttatggcttaaactaattaaattggaacaatcattgttgactccagactaaaaagctttgcagaaactaaataagggaacttgagttatcacgattttaagcaccaaactcaagttttgtcactattcgtcatatatattttatcaatcaaattacctggggaaaatagatgtatttgttacattgaaaatgacatgaattcatatcctttgatataaaatgccacccctttaacaacacagcattggttgtaccttcgttatttagtgcagtgttggaattgtacacacacaattatttcaatatagcaataaaacgatgcaactacttgggtttgactttacatttagcaagtagagaggttagttggtcctgaaaatgatgtccaaaccctaatgtgatattatgtttttcagctataatttagacaaatacacaaccgatccaaaaaaaataaaaaatacagcatatactaatatggtgtgtttaattaatatagtttttaaccaatataacaagacctattaacttttgaatttgtcaactccaactttaaggattgaagttaaggagataaaaatatgtctttatttctttaatctttgttaacatatcttgcatattaattggaaatatgatcaaagtaattcttttacgaattgaaccgtacaatcctctcttcttaaattagtttttgaagtttagttgattaagttgatctatttttagcttttaaaaaaaataaagttaaactatttctaaaaaaaatatttcttctaaactcgtatataagcaaaacaaatgttcttgtatgttaaacttaaaatataagtaaatttaactaattttaacatatttagttttatcattcttaaaatatttttatttaattctaattctatatattttcaataatttattattattcacaataacaagtttcaacaaaatacattttagaaataatcttatttttttatttgaaattataatcaggaaaattaaataattaataatatcaactaacttttaaattaataagaaattaattatttttatttatatattaatatatgagtctcaaatgtaaaggtcattgtgagaaatgtcctcagacctcaaggacaattaaaatagatacaacgaatttttcataatttaatcccataattaattcaactaattcaaacttcgatattaagattttcttaaggacaacatctatatataatttatctctacacgacgactagtaggcaaatatattttctttaaggtcatttactctctacataactacattacaatcttaaacatgtacaacatgtaaacattattttccaggaaagattttaaaaatataatcatttaaaaaaaaacatgactggtcaaaataatctaaaacctgatttaaatcaaaagctattttgcataacttatcataaattaatttttcttaaaaaagtgatttttatgattataaataagcataaattaatttatatttttatttttaaaacaaaatattaaattattttatagcaaggtcactttttttaatagataataaactcgtcctttttctttctttttttcaatgttatagaaacgaagtttctaataattttgttaagtggtaactattaatctttgtaaaagacattgttgatttcatcatctttaataaaatctcatatatatgttaacacatgcaccttctttgaatccacaaagttcataaacacacgaaacataactagaaaaatgaaccggagttttaatttagtcagacaacataattaatgttggtaaaatgcaccaacacagggaattaaaagggactatatgtgatggatgaatccttccacgattcaagcaacaaactcagactcggagtgcacttgtccaacgtcctcctcctcctcctcctcgggtcccacaacagtttcaggttccgctgttgtccctaccacctcggactctgtacctagtacttcttcttcttccattgagacattattatcaaacgcaaccttctcgcgacaaatgggacagttcatgtgtgagggtaaccacgcatcaatacaatgctggtggaaaatatgttcacattttggtagcatctttaccacatcacagtcttcaaactcgcctaagcacacggcgcactcctccgccgccacattctccttctccaccgtcgagtaaacgaagacgggacacttgtcgaccgtttcttggccgctgacgacggcgacagcggcaggcacgtctctatgggtttgggagcgaagtcgaatgcagacataagacactataaacacaaagatcccacctaagatcaaacacatcgccgcactcacacccgctgccaccttcgagttttcatcatgtagcttcagagactcgctaagccccatttctcaactgtttcagtaccaaaccaatctacaataaatttttaaattaaccatcagacgacactttctatatatatatatatatatatatatatatatatatatatatatatataagaaaaaacatattatttgagaagaatatgtattttatagataaaaaaaattaaatttaaacagtataatcaaatataaactgttaaaacttattattatgtaactatttaaaaaaaacatgtgagtttttttaaaatatatgattttttaaaattaaattttaataatttatgtataattatactgttcaaatttgattatctcattcttatatataaaaatgtttccttgtatatatgcatgtatattaaaataattaatgttattaatgatgaaaaaataattatcgttactaaacttggacattttgtatggttaatcctcacaagagaagggatgttttaactctatgaatatatatatggaggtaggtatatgaatacatatatatatatatatatatatatgattgttttaattctatgaggagtagctagctagtgatgtttggaactagctttggtggtttcttatataaaaaagaagaggaggaagaagggtccgggcggtggtggcacaaggaagtgacacgatggtagcagtatgaggcggatgcatttgctgctacatacaaaacatgttaaattaattaattacgttttagctaggtgtgctttaatttgttggtcttcaaactaataaaatattaaataatatttaaaataataaaattatataattaactagaagctaaataaagtattaaatatctatcaatttagtttttactgagagttgatatactttactaacattaggcaatgttttgaagagttttttaatacttgaggactatgtagcatgatctttaatattttaggaataacttatatagtttcattagttaaagagttatttaggagagagggtgacgcttaaggaatcgaattgatagtttatttattagataatcttaaactatcacaccaaaaaaaaaaaccgggcaaacacagtccgttggcttccatagaacaatattgtggcaacttagacctaagttgtcatattggatctttggaaaccatcacaagtgtggccggcctatatttatgtttcaatctcaaccaatttctatgtgatatataattgaattttttaatttagaaaaaagaattaataaaactcacatctattacgagctatgcaaagattatttggtatcataatacaatttacttacacatggaattaaattaagaataaactacacatatatggactaagttaataaaatgcatgtataaagattaaattaagaatgaactatacgtataaagacaagaatgcataaaagagttcaaaattaacgtatgatggtaggaaataaatcggttacggttgcacttatagtgactgatttaattaataggtttgtacacatacatgactaaattgtatgtttaatcttagttttatttttcaatctaatactgagaaagcaggtgacaaaaagaacaagaaaaaagtagctcaatttctggctttcttttagaaaaagtgaacagaacaaacgcaaattcactatcaataaaaaatagtttcttaggataaagaaattggtgatgaaaaaataaagaaaagaaatgagatattactatttcaaagtctaaatttctaaaacaacatttagttaactgaatgtagtgatttaacacatttcaaagttttaaagttggtatccatggcagcttgagaatctaaaaaaagaggttgaccgaaagagtaaaaatccataatcgtgataaatcaagattgaaaataaaaaaactacataaccttgctcatgtcatatatagataatagtggctaataacatatatcatttttactaagataaaaatgacctttctatgaggtaagagcattatttgcagttatagtagtctaattaaatggaaaataacttagaagtgagtgaagtcagcgaactatggactagagtagtttttttcttaattatgatagttaaagactttggactagagtttttttttttttttttttttttttaatgatagttaaaggcaaatatgtgtggtgttgttgtacatttaatctccaccgcttcattcttcatggactttttcttttcattaatgtgtggattctagccctttcttttggaaaataatataaaaaggctaaaattcgaattcattaatgataagaagaaaaataccatttcttttgacaactttttttaattcttttcacaccccttccttttattgtatttttctaacaccaaaaggaccctcactaatagttttctaacaccaaaaatactctcacgtccacctcatttaagccattttactttcccttccaccttatcttttcttgctccgagtactcctcatttcctttcccttcttcactgtctggtgagggttcccccaccccgcagattttacaaaaaatagttttcataattaatgtagtttcatacataaatctataatttcattttactaatatgatacgtaaactataatttctataatgtatgtacacattatggaaactaaatttcttaacgtattaatatttgagtctgtttagatgttagcttctctaaaaacacttctaaaagagaaaagtaagaagaaaaaaatgaaatgagatttttcataaactaaaataagtatttcattaggtaatttgtagatgtcatctcatcttttagagaagttacattggtgagcttctacaaattaactaatggagaacttatttttatttatggagaaacttatttcatctttttgttcttattttctttttttagaaatgcttttagagaaacttacccaatcagactatttatcttatgtgtttgtgcaaacttgaatatagcacgtaaaatatataggtgtttgctctaaagggactgattgtaccgtattgtttgtctgagtgacattagatttcttaagcaagaaattaaggttgaatactgttaaggaaaaaaaatcagagaagatatcccattaaaaataactaatcagattttctctaataaaaattaattattatcaataaaattaataattatttcactaatatcatagtcacccaaaaaagaaaattatacataaaataatggttttataatataataaataattaagataaaaaatagatactttattataaacattgcaattgttatattctctatttaattcgatattccatctccagtaaaaaacaactacaaagaaaataattatttttttgggatatacaaagtgtcctaataaattttgtctactaaacaattggctaaatagagtttaatcgaatgggaatggtaaaaatcatgacacgtacataggcgcagcgtgacttcaacgtcaatcgtcacatgactgtcttagaaaagcacttatccagctaattatcacatgcatgcacctacgcgacgtcctttcctcacaaagccacacatgcattattagcctttttaataaaaaaaaaagtgacgatttcctctcaaaattaattacttattaattttttaaaaggtttaattatcaatacatgataaatagctttcgtaaagtatgactttttaatttcttaatgcaaataacttctagccacttaattatgacaatagttaattagtaattaattttgaatctttgatcagtaattaaatttgtcatttccgatttttgatttgatcaaatatgaacttgttgggtgcctgggatatccccattttgttttatagtttccggctttctgcttttcggcatatatatatatatatatatatatatatatatatatatatatatatatataggtggttaatttccttcttgggaaaactttttagcagttgtaatgaccacaataatttgatgtttgagaaaatatttgcccccaattaaaataatgaacaaaatcagttccaccatgtacagaaggttgaaggttcagctgcatataatttatataactgttttcaatctttggatgatcaaatccggttaattctttgtttagaaacattacaaaattccttcttttgttcaaggtcacatttgccctatgtttgtcaaatttgatgccaaaatgtgtgttcccggcctcaacccttgaagagtgtggcttgttagctagtgtctttcatggagatataattgaccggtttaaattagggacagatataaaaacccatttaattaaccaataaaaaccgatgtagttaattgattaataggagttaggtttcttgaaccaggtcaattagttaagattcaattgtactacgtactaatattacgaaaattaaaaaacttcatttgaagagatcatacacatacttatttcaatattcatatctttaatttaagaaggattgatctctttcttttgaagaaatactcttaatataaactgaaaaatatgtaaaatcactcacttacagttttataattcaagtctattcttgtcattttttaataatttttttcgaggagttaggtttcttgaacaggtcaattagttaagattcaattgtactagtacgtactacgtactgatattacgaaaattaaaagaattcatttgaagagttcatacacatacttatttcaatatttatatatttaatttaagaaggattgatctctttctgttaaagaaatactcttaatataaactgaaaaatatgtaaaatccttcacttatagttttataattcaaattcattcttgtcattttttaataatttttttttctgattagatgcatctcctttatattaataatggtaaatattaattattttatgtttatattttccttaaaattagtagatattaattaatgaattctgtaaaaatattatttaaagacattaaagtaaaagtttttatcagaaagtattaaatatataaaaaatatttaatacttactttttaaaataatttaaaaatatttatttttaactttaaggcattaattagtaaaactaaccttacaaaattcatgactgaattctttagcatttgaaacaattataaaaagggtaagtcattagtgcagaaaaaggatttatattgtctcaattgctacttgggaattttatgccagtttttacaacctactattttttcgaaaattcaaaataaaaaaaatgaagtataacaatgatttattttttattatttgaattcaaaacagtttcttatttaattaaaaaagtaagaaaaagaaaatataattatataaaacccttgttttacataaaaatgttttcctcatttttttttatcgtatttgaaaatgttttcactcaaaccaaataaagagtacttttagaaaacatatattcaatttgaatgtttagtcactttgtagatatgtttaacgtaaatttattcggaatttgttttgggagggcttctattgtaaaagggtttttataaaaataagtcagaagaataacttgtttttaattacatttttttatctccttactttcttaatttcacaaattttgtcttattattaatattttctttaaaaataatttttcacggtttcaattctgctgttttaactgatttgttaacttcacatttaatatttaacaaaaatatttatatgaccctccaatggactgtcacatttgtatatttatgttgacgtgacactttatcacatatgtcacgttagaatttttctttaaaattagatgttgttaatgactgaattaaatttgtacgattaaaataacaaggtaaacaaaaatagagagatggaattcacaaaattaaaaaattaagaaaaataaaaagtacaattaaacaaaaccatcagtttttttttttttagaatgaagttcattttattaattgtgtaaatggagagaaaaaaaaagttaaaattaacagtgtactgttgaaaaaaaacgtgagaggacatatcttgtaataagtttccatggtaagagaagtgatagtaaaatattttttaatattctctttttttagttttattattaactaaaatttatcaaaaattacaaaatcataaaagaatcattaaataagataagatgtagaattcatattttaattttgtaagtttcaagacaaagcatgtttaaaagaatgtcaaataaggtattcctaatatttttttatgtttttattacccattttggttcttaaatttacaaaaagaaaaacactctattttttccatccctatacttaaaaacatcatattttagtttttacatataccattttaaatctattcaattttacatatatcattttattttcttttagtccctacaaccaggattaaaagagattaaaaatgtttataggggctaaaggaaatgcttttgagtatatgaagtaaaggagatcgaaagtttttgtaacttatagaaactaaatgaaaaatttaatcaaattacatatagcaatttaaatcaaatataacataatatttaaatctacattttggtaatacacaacaatgtccataaaatccttaaaaaaacaaagtgcataagcaaaacataacaaacaccttaaattgattttcatatttttaagaaaaataaaataaattaatgttgttttaaccattttttactaattaaaactaattttgtaatattttattgattattgactgattttaaatttttttaactaattattctcaggactgattatgtgatctatttcaactaaattggtctgacttaccagtgttttcgatccaactagccgttaattttcaaagcataggttttgaaaatcttgtcaaccccttcattaataaacatactagtattatttcatgctaaaatctattttaaaataagcaagtgttaattaaagttttaaacatattatttaaagaattcaaattaataaatgtaattagaaatattcaatacttaattgttttaaaaacaatttagaaaatttaatataaaaatttaatgataaatttagtttaacttaaaaataaatcaaaggacacttgtctaatactaagtccataactatattattatactaataattaattattatataaagtgcaaaagtgaagagaaattgaaagagtttagtgacaaaatgatccgataaagataaaaaattaaaatttaatttttgaatgtacaaaaattatgacaaatttaatgattaattaatttttaaattttataatttaatgtttaattgattataaaaaaatataatttattgttattcttaaacattataacttaataatataatgatctcacaaatttaatgctaatttatcatatttttttcacataaattagatttgtatttttcaagatcaatttatcatcacactttcacactttagggactaattttactattaaccccagaacctatttttatttgttagtactaaaaaaagggataagaacaagaagatgcaatggtagcaaaagcaggaggagcggttaaactcagggaatgagaagtgagagtaacggctataaaaaagcgcaatcaaagtgaataaacgaatagtagcctttgatgccaaagagaatccaacggtcaagattgaatataaaatcgaccgttggagttgagggcgttgtcgtataaaaaaacatagccgtagacccaaacgtttcatttctcaaaggaacaaagaaaccaagaagcaacacactgtttcatactttcgtttcgtacattcggtgtagaagcaaaagagagagagggaaaaaggttgataccaacaacaaacaaacgcagtgcttgattccgcggtggcgacaaccgacgtgagcggcggaggagaggcgcggaacggaggtcttcagggttttctgtcgtcgctgttctcgactcttggcggtgttttcgggtcaacgtctcaagaaccgcatcaaagtgttatcatggcttccagattggaacaacagcaacaacccatcaatggtttttgttcttctttttcttgttttcttgctgccggtgttgataaatgtttgaatgttttaggttttaagatttgtttggataaagtttggttttttattttttcgtttctgaaattcccccttttgtgattttttttggtgtggtttagttggtgatgagaataagcagaaaaacaagggtggtgaaggaagaaacagaagggtgctgcaggatattgggaatctcgtgggtaaacaaggccatggaaatggaattaacgtgtctaaacctgtcacaaggttttttcttttttcttttctttggaaatgttttatttttttaagctctcataatttttcttctgttttcttttgcctaattctgctcttttcttttttactaggaactttcgtgctcaactattggctaatgcacaagccgcaacagaaaagaacaaggttgttattctctttcccctgatttttttaggactttttagtttttacctatctgattttcaaagaaaccagtgaagaaatttgttttctttttggtaacggatgtgtctctaaatctgtgtgaatggttgttatccagaaattaagcactgaagtgaacaagggagcagtggtagcaactgatggcgttggtgttgggaattttgttcctgctagaaaggtggaagcagcaaagaagcctaaagaagaacctgaagtgattgtgattagctctgatgatgaatcagaagaaaagcaagctgtcaagggaaaaaaggcgagggaaaaatcttccatgaagaatggcaaggccttcagttctgtcctctctgctagaagcaaggttgatccttttttcttcattcttctgaatgtggtttgggactttgtgggttgccctttttctggtacatggtctaacagcttgttaacctcaggctgcttgtggacttccaagggattttgtggtgaacattgatgcaactgacatggacaatgaattggcagcagcggagtacatagatgatgtctacaaattttacaaagagactgaagtaatgctctatgcttttttctttgtttaatccctataatccccttttcttatgcacttcttatattatacatacgtgtatttgattttgatgaaacagaaagatggttgtgtgcatgactacatgggttcgcagccagatattaatgccaagatgaggtcaatccttgtggactggttggtagaagtgcataggaagtttgagctcatgccagaaactctttatttgaccttgaacattgtcgatcggttcctgtctgtgaaggctgtgcctagaagggagcttcagctggttggcatcagctcaatgctgatagcctcaaaatatgaagagatatgggcaccagaggtggaattccttctcttctatgatgatttatggatcatgttttgggaaagtgcttacttatgagttatggtgtggatttccaatgtatatttgcaggttaatgactttgtgtgcatatcagacaatgcttatgttagtgaacaagtgttgatgatggagaaaacaatccttaggaaacttgaatggtacttaacagttccaacaccctatcacttcttggttaggtataccaaagcctccactccatctgacaaagaggtatattttggtagttggttgttaagtttttgtttttttttaaagattccagagtggaatggcctgatgaatatgcctaattttcatcaatgtagatggagaacatggtgttttttcttgctgaacttggattgatgcattatcctactgtaatcttgtaccgcccttctctgattgctgcttctgctgtgtttgcggctcgatgtacccttggaaggagccctttctggacaaacactttgatgcactacacaggctactctgaggagcaactaaggttaatattttcttggaccagcaaatttgtattttaaaaatgcaagtagttaatgtgttttttcaacattcatgaagtgactcttgcttatttttgctgccagggattgcgccaaaatcatgggcaaccttcatgctgctgcaccaggaagtaagcttagggcagtttacaagaaattctgtaactcggatctttctgctgttgctcttctttctccagcaaaggacttgtctgcactgtcttgaacaagctttagggaagtttaggttattttaggcctcgatcatgactgttatgatctatattatatggctttgtattcgtttatacttgaacaagctttagggaagtttaggttattttaggcctcgatcatgactgttatgatctatattatatggctttgtattcgtttatatttttttttcagtgtgatacacaaagtgtttgtatttggaatttgctaggaattgcttgaagcctcaagcaaagtttgatgattctttttgtgtaaagagcagaatttgaaatattgctaggaaatattgagtgagctttgtgaactctcattttcttctcttctaatatttttgccacaatgctttcacgttgtgtggttgtttcattctcattgatggcccaaaaaagtatttgatgaagtgtctgtagatggatgtgtgtgtgatgtttcagaatatgattcttgaaggtctgtgttatatataaataactatgaaagcttaagcaatacgttcagaatatgatttcatctcgcatcatcaatattttgaataaaccactcaagtacagcatatgatgcagccagatcaatctatcaagcacaaaacaaaggtacacagtattcaccaagttttcgatcaatatcacattgtgttcacgaggacttctgaccacaagaggggagccgtttggaaacaattttgtttcaatttcagaacccagtagactttacaaagaatacataaattgaacaagctcctaaaaatttatagatttttgttacgtgtgagctagactaaattaatctgctcttcctgagaggggttgggaatagtattagtagcttcttcatcctctgtttcttctataggttcagcaggcctttggtttggaattgcaaacatgtagttgggactgattaatgtgtcctgatcaagtggaagagggataccaggtcctgctatagactttgacaatggtatcttgttgcggttatgagccaactccagaagaacctgccaagtgattacaataaacatgttatctttcaggaagacataccattgcttgaaggaaaaaaaaaacagatggtattgtgtgtcaccaaatggacagggatcctttcaggcaagcaaatatttcacgacaccgtaactatctagaaagtagaaatctattgctgagattaatattgttagttacaggtcctagtaccatgattgtcagaaagtaacagaactgaactattttcttctgataggtttttacttaagttgtagtaatagacgcctagacttcatggcttgtttgtttgaaagattttcttgccaagcttggcaagttgttagaaaggtggggcctagaaagtaattttccttctttttggatgtgaaagaaaatctaaccattgggtaaggagattgaaaagtggcaaattactaatattacctcacgagggggtggttgcgagaaactgaagttaagcttggattgaatagcaagcttaacatcatcacagtcgatttcagacttgcctgcatgctctgaatacacttgagcatccgttaattcgtcaacaatataacgataccataactcaagaaacttgtgtataacacgaggttcatagtcctccacgcccattgatttcatcaaaaacttcacaatatttgcatcccttggcatagcctcttcatctttatctgccatatctgtcacggcacccaaaaaaagcaattattgatgatttgaaacaaatggataattgaattttatgttcataaatttcaatggtgttgaaagttccaatctttgatatgggggttttgtaggaagagaaagacaaataatatgcaatagttgtgaaatggtgaattgaagaaagtgagacaaatttacaaaaataaaagggaaaagagggcaaaatgagaaaaagcattccaaggaaggatagaaacaggccagatcaagttaaacttggcgttcctatttacaaagcttgacctgtttacctgcatagcctctttttaggtttggcctaacttgtttaaaagtctggccaggtctaaaagactgtataaggtcagttaacttatcagcttaagtaggccaaataagcataagtatgccaataggcctttcatcataagaatgccagataacaatgccattgtaatctctacatgaccaccatcatgataaatgattaggtattactagattatcatggtttcaactaatctctacatgacatataatcgagtgttgttaattctttctcttaaattgaaaaacttggatgcatgtcgcctaaaaattgataagaaccatagataagataggtggtggtctgggacaacctaataatttctccaacctaaataggccacctatctgtacctacatcatattaacctattttacaaacataaacaactgcatactactaaggtgtgatcttggctaattacatcaaatcaaatttaaataattgcaaagaagtttctaagcttgaaggtgaaaaatcaatgactataaaaagctctaatgtattatccattaggagacagaatatatgtgtatatagtaaagccaatcccagaacagaacaagaagcatttagacagctagaatcacgaacaaaaacaaattcatagattgcattgataaagatattcacaaaatacaaatataaatcgaaacatgcaccactcataaaactctcaacactttcacagcagagaagggaaagagataacgaactcacgtgccggataaggctttcccgttggttttacgattctacgtcaactcacgtcggtgcggagatgagccgccgaaaaatgctatgccgaccaccgtgccggaatcggagagcttctctgctgaaaagtgaaaactccagttagatgtttatttctgaactatgattagggtttggatctaaatctaataataatgatagtgaaaaataactcacaaagtaaacaaatagtattatttaaagagaataaaatgtattttttattattaacaataaacagtaccttttttgtaattaatttttttaactgattatctcttttaatctacccttctcgtcctcttttcaaaattgaatttcaatatatatttaaatagttttaacgattagaaaatcttgtatcataatataaattattaatcataaattcaaaatttagtgtatatgttaaaaatatttatttatcacaaatattaattataatataattttatgtatttaaaaatatttatttaatataatttttaaaaatttaataatctgtatcaataaaaaatataattaatataatttttaagagatattataaaagttaataaatttattatatataatgaggtgtgatttgatagctctaatttatttacatgtattacctattttttcaaatttaaattatataaaaataaatatttatatttattcagtacattttaaaggttaaaatacaaaatttatgtaaaatgaatctttggttaatctactacttaaaataaacttctattatttttcttataactttcaaaatagaaatataaaaacagaaccttttccttcttctttttttgttagatatccctctccctcctttgagagcattccttttcacaattggatgcttgagtccaccgtttgtaattaactcagtatcctatataattaccatttctaaatcattggcggggttgtgttgtgtatataacctacctccatatgaagtcggatttgtttgtatatctgtgtttaactttaacgtaaatccttcaaatatctctagtcatgcttgcgtttttggaaaagtggaaaatcgatacttatacgtgtatactatcccacacttaggtagcgttccgatggtagaaaagaaaattaggaatgaaagtgtaaaaaatgaaagagagatgaaagggaaatcgttcagagatgcaatgaggtgaacattttaaatttaaatgatttaataggtaataaaatgaaaaaaaattaaattaaaaacatttatatgattctaattttatcctgtcttttttttttgttttaatatgttttttaacttgtgattgtgcatgagttataaaaagcaagtgacatattcaattttgctagccaaacaaagatatattcgatttctcactgagcatgcattataaaaaacaaatatttgaagagtactgctattcagtatgaatagcgtaaacacgaaacgcacgaacggttcatgacttcttgtactttgataccatttttttaaaaataaatataattaaaacattgaaaaaataaagtatattttaatggaaaaacaagtgctcaaaacaaggtttgtgtaaattgcacaaaaaaactattcgtatcaaataacatttttgatattcgaatatgtctccatcataatcaattttgctaaccataatcaaatatgaaatgcagcataatcaaatataaaaaaattattgtctgcacgtgtgcgtatcctatgagctaacaagtttaaatttgaaaacactcaaattcacatttttattgtattttttatttatcttttatctctgttttgtgaagaaaattacactcgtgaatcccattgtttctgaagatattttattgtaactttcagttcaaccgaactaatgaaagtgtgcatttcttttctttttcattgctgttataactttttccgcttctttcctactgaaaaaagacaaccttaaaagttaaggagttcctaatcaaccatcacaccttgccttgtgaattcactgaattgtgatgcctacattgatgaatgaattaaaacaatgacaatgattgcgtttgtatttgttttttcaaatgaaaattgagaataaaaagacaagaacatgattgagataaggaactagcagccccttggcccttcccatgtgtacatgtcctactcaacggagatttttgctcttttaggaatattttttatttaaattttgtaattttttaatttaagatgtcgtaaaaattagaaaaaatctaaattcaaataacaaatcactatcaagatatttacatagcatagaaaaagaagggcttataagttccccgcatgtatcaataactttagcaaaaacttaaagattttattagattaataaaaataaattaaggttgaaaagtaattcgttgtgcttaacttgaggtgaaggcccaacgcaaataattgagatgcagtaggggatggaatctctaaagacattctaacaccaagtcaatgaatttccccccaacaaaataaaaatgtgaaaaattgcttatttggttaggttttagttagagtaagaggcaatatcatattttgcctaacagcatgcaatgcgtaagtggtttgtggttacatcaaatgaatattttggaacctgtgaatgtcatacaaattgtatgatcataatgtgtgagatcctctgggtctcatgtaaagtagagttcattagagtataatgtcatttaaaagcaagtgcatccaattaagttggaaggataatatattacccaaattgtatctttcatcctctagactaatgtgaaaatatagtcatgataaacccttaattagccactacatgcatctatctattgttcattgaaaaaattgttattaatatagatacccaacttcataagtaattaaatgtatagaggcccaataggtgtcagaaaaatataagaatatagccattatagcaaattagaaacgcagttattgtagctaaaagaattagcagcgcgataattccatttaatgtataaagacctaatggtaataagcaattaattgtgattgattctgaaataggtttattaggaaagaattattttttattgcaatatatcaagtgtccaatgtatgccataataattcatatgtgcacacgttgtggaaggggaatatgctcttgcatcattggagcaatgatttcaaaatttactggataacagttatttattatgcttatttgtaagctgcataggtaaaagttagttttttcttcttgcagttgttggtgatgtatttcttgtatagattcaatgaaaacataacagagaaaaatatttttctcaaagtaatttattttaactttccaataatgtacatactttcttatgaattgacttcccgtttcgtatgcatttttttttataaaatttctttgttgatagtgatttttacagcttgttgatagtgattagtgagtgccaaccgtcacactattaccgattacgcgatttcttttctcaaaattattcttaattaccaacacaaatcccgttcaacaggtttcacctgtgcttttgcatggattctgttattatataaacctcaaaagttttgagggttaaataaaataattttttcacctcaacaattattgagacttactctaaggagagtttggtaggagttttttttttttttttttcatattcaaaaaatatgattccttagaaaactgattatgagaaattatgactcttgagaatatgtttgattaatcttaatatattttttatgagttaaagattcatataaaatagataagtgtaactttctctttatttggaaaagttggatttctactcgtttttgggaatatttttgcaaaaagtgagctaaaattgatttcttaattataatttctgacaatctttttttattaattgtatattaaatatgagaatcattgttttttattttaagatttcttagaaaagtagaaacttttcatctaccaaccaatgcacataaaaactattattagcatatcaaattctttctacttatattaaaaaaaatatgtgttattattataaattttcttatactatcaactaaaaagaaattatgtaagcattacttctaaaataatcatgacaaaattaacatcaacaaataagacaaaatcataatgttatcgtattagttcaagacttcctagatttatatgtaaaaaataatttatttaatcagagaatttatatttaatttttttatatttaaatttttcttgcatcagcgataatcatatcctataaacaggattagtgtctgaagttagaatacatacttagtatactaaggataaatttattattatttaataacaatataaagtctacaatggatgtatatactgtttatttatttacttaaaaaagcttataattgtgagaagttttccttgactccactggcaccaccaacaaatcccagtcaaataactaacacggaaagcaacctccaatgcattgaacgtgaataatataattgcagacgaaacattagaaaaagaagaaaaagagagagggttggcactcttaaatttttttgaagcaaaaaaaaagaaaatggaagctgtgtgagtgaagtaaacgttgaacagctaggaaggccatggaatgggaccctgaaatggacgagatttaagtttaaagcataagcatgatgaaaggtaatggtaatggtagtagcaatactactagttgtaatagcaacaaacataacaaatagttgtagttgtatgtaacatctttaagacaaggatccaagtaagcctagttccattcaaagctgttgttgtttttgtggttgtggccaacgttcacacaaagacaacacaacataacacaaaacgttaacactaaaatcccgtaaagggggggtcacttcacccacgggcggcacaacacaacctattctttttccctttgcttcctcttttcaaaaagcaaagctttcatctttctctctatccatatgctgtgtatatgcttattctctctgttctctctctctctaaaaccattgatctgaccactgcttgtgtactatagccaaattggagaaaaccattttgcatctgatcccagaatcactagcctagctaccgattttctaccttctcatgacctgtaagttaaagttttcttctttttgtctttttcctgttacccttttcctcactgcttcaactcaaaaaaaaaaaaaaaaaaggaattgcggggttttgtttccttgcggaaaactttcaaaatatgctttgacttcagtaggcctattgggttgtggtgttatggtatctctatttattagtttctcatttttattatgctttgttttgttttgtactttttgtttttgttctcttcatgtatatatctgagtatgtgcatgttccctttttttttttcttttaattattctaagctataatttgttgaatttcctttgctaaagggcgtgtttttgtgattggcagaggtaattggttgtgaaaaatgacgaggttgactcgtgattttggtgatacaatgcaaagggaggctgtgcctgcggtttattctgatgttctgtttgcttctaatcggtttcctaattacagaattggagctaacaatcagataatagagacaaaggatgacccaaaagtgctatcaatgaaggatgttgttgcacgtgagactgcacagctgttggaacagcataatcgtctctccgttcgcgaccttgctagtaaattcgagaagggtttggcggccgcggctaagttgtctgaagaggttacccttccttctggttgaaattcatttccccccctaggaatatagttcttccttttggagggttttgcaacctgagattcttattgtaaaatgtttgcaactgaaataaccaatgatcatattcgtagtttcctaataaactgatgtcccttttttaactagctttttgtatgctggtgaagttcaggctagacttagagagacagcatcattggaaaaacatgttcttttgaagaagcttagagatgcacttgaatccttaaaagggcgtgtggcaggcagaaacaaggatgatgtagaagaaactattgcgatggttagttctttttttttttaaagaagatatatacttcacatttgtttctatctaacagatatatgttcatatttattctgtatgaagctgacagtataaatataaagtcttgtttgttctctttaaaagtcaaattgggagtgtgtatgtgaggaatggaaaggctttgagaatgaacttgggaatactttttactaaattttgcataagcttgtagaagaaaaatttattatctagataatactaaataccttcattgcttcaatcacagaaaaataattttaatttttttaatggaatattcatcctggtgctagtttttttgtgcatttgcaatctttttaagagatgcaactgtaacttattttgtgcattcttcaggttgaagctctagcagttcagttgactcagagggaaggggaactaatacaagagaaggcagaggtgaagaagcttgcaaattttcttaagcaggtgaattaactttttatgtggtgatggaagaagttttattagaaataggaagaaaagaagaaaggagtaaagaaatatgttgttagtttatatcttctttatatgcctgcataaagaaatttcctttaccaatgctgagaatttatattaatttataggcttctgaagatgccaagaaacttgttgatgaggaaagagcttttgctcgtgctgaaatagaggatgccagagcagcagttcaaagagtggaagaggcacttcaagaacatgagagaatgtctcaagcttccgggaaacaggtttgtgatatttacttgtcatttgtcatgttttatcatggggaatttagtaattcatgatgccataatgataagtgcatccgacttaaatatcatattcttaagattttattttattgtttaaaattattcttcaatgtttcttgcatttatgtttttcctcccttctagttttctgttctgcttgaaagcctggagccctggactaaacatcttactcttttggcaattgttattatgtgatacccttgagctactgcttcccctttctatgcattgttagtaataatcatttgaataacatttggctctatggttaggacctggagcaattaacgagggaggttcaagaggctcgaagaattaaaatgctgcatcagccaagcaaggtatatattgaacacatgtccctattttgtctctcatatatctgctatttcaaatgccttctctttttctaggttccatttgtcttgggtgtgccaatctcttaattgttttcctgtatagaattggctttcttccctttattttcttagacttcatttttctttgtcgttaacattttatcaagttatttcaaagtgatgaatacattgattgttgattgatatataggtcatggatatggaacatgagcttcaagcattgagggctcaacttgcagagaagactagacagtatcttcaacttcagaaggaggtatgcctgtcatcttatgccatgtcgaaaagattattttgtgaaatgcatccatggtcaattctttgatattttctcagcattatgtggaagactttaagctgttagttttttaattagcatgttatgatgaatcacattatgtaacttcaatttggtttttggtttggcggttgagaatccgtgttcataacatggtttgacatcatgcacggattatgtggataatatgctttttcgattgttgtgtgtgtatcacaactattggggcattttatgtcatctatgcttcaggtcatgcagcgaatactttcatgctgttaaattctctggcaatactgaaaatctggtcctataattctttcatatttcttttatttttctattagtgatgtaaaaaaaaaaaaagaaactaaatacaatatgaaaaacatcaaacatgtgaattttcatattcctttgctgctgtatatgatctttagatagacttgggggaatcttctaatgtcttacacggtgtgatggaaaattccatgatggtttttaatgatatgaataagaattagaatttgggatttgatgttaaactatattgttgtcttaagtgaatgttaagtttctttccttaaatggaagactttcgtgattgtcttccattgaccattgtaatcttcttttactgattatccttgatgctactgttcagttaacaaggacgaagaaaggtggggaaaatgttccacatttatatgaacttgaagggaatgaaacgttaggttcttatttgcaaattcaaccttgctctgataatgcccctgaagtttcaaaatgttcaattcagtggtatcgtgtatcatctgatggtgccaaaaaagaacttatctcaggtattgtttctgtggttttctttttctttttttgttgagtatgcaagtcaattgactcttggtttatgcatttttcaacttctggtataacactttttattatgtcacttcccgggagcagaatgtgaataacagttttggtgacagcaactcgatccttagtatttgtagaaaattataaatgacatactggcagcactcaaaccctcacctactgataaacttgttaacttttttcatcatagatgtatgttcaaactgattgcttgttttgtgtatatactaatgattttttttttattcatacatctgacttgctttttgtggctattatacattaatgttaatcaatcagaatcttaactgtcagtggggcttattatgtaagctgttctgttcaagatactggaaggctgattgttattaaacatgtcatccaattagttctttgtttttatctttgcttatcatataatacaactttctcaggagcaaccaaaacagtttatgcccctgaaccttttgatgttggacgcatattgcaagttgatattatttcagaaagcgagcacgtcacactttcaaccgctggtccaatagatccaggtctggtttcaatttgagttgtcctcatttgcattagtagtcatttacaggcattgcttctatatatttgtttctatttcaaacataaagttgttttcttatcagttaagagattgaaacatgtgttctgaaatcatgtcgagcttaaatttatttcgtactcttatgcagctgctggtttgggaacctatgtagaggcactagtgcgcaaacatgacactgaattcaacgtatgttgctcttatccttttaacttttatataattatatgaaagccttgttaaattgagctgttttttgactgaaatgtgtatggttccatgggttgttgctgacttgcttcagtcttgtaatcaaaattttaaaagtagtgtttagttttgacgaattgctgttgtcttgtactttttctccacattccaatataaaaagtttagaagtcaaatctagtcagattatgtgacaataatattgtagttgcatttactactttgcaggtggttgtaacacagatgaatggttcacatcatccaactgaatctattcatgtgcttcatgttggaaagatgaggattaaactttgtaaaggaaagacaacaattgccaaagaatactattcaagttcaatgcaggtatttcaaatagttgatgatatctatattttgattttgacaagcaaaacaatgttctaacctctttcttgcacatagtttaactaacattgtgcattgaagaattatttgaagccattttgatgtttatgaaaatacatatgttttcatgctcttttgaatgtgttatcctcccttgtcatttatgataaactggaatttggtcaaccattgtgctttgatcttgttttctttagctttgtggagttcgcggaggtggaaatgctgctgcacaagcactattttggcagccaaagcagggacattcttttgtattagcttttgaatcagagagagaaaggaatgctgccatcatgcttgcaaggagatttgcatttgactgtaatgtatgtctttctgaaacttaaatatatgttaattcaacttttctctaatattttttttggtcaccatttctaaattgcaaatgcaaataatgccagatcatgcttgctggaccagatgacagagctcctctagggacatgatgagcctccttacatcttatttccccccttgtaattatgagttttttctaccttgtattataagtgttatttcaacagtaaaatctacattgctatattggtaagttagtaatgattcataccttgtggtctgaatcatttatataattttgtttcatcagtccaaggcatttttttatttgcctttgtgagtcgtaagttttaggttacattataattataatagaatccgtggctgccatgtcgaagtgtttgagatgctaattggttgtatttgatagacagacattcagacaatttacagagaattctgattgcattttgtctatggacactggcctcgacaggacaatatgtgaatctaccctcattatgtaatataatataagagaatccaatgtatattgctagatttacctcaaaagaatccaatgtagtgtccaagatactataaaatagaaatgtttttgtctactgcctaggcctaccattacaactgtatatgtatgggaggtttatccataatattttttttggtaaatgaggtttatccataaattaggaattctcagcaataaccaaaaaaagagagaaagaaatagcagaagagtaaaatcttaaagtctgattaatctattattattagcctttgactttgagctatttgtttggtgtaatgtgtgtaactctgtaatgttaattggaagctaactgctattagctctaaaatttctcatcaatgaacagtgagattctacatttcttctctaaaataaacaaagaataatcaacttataagttaatcaagcagcttataaacaactagagtgacttgttaaacacactctacatctttttgacaaaaatcaatatattcatctattgcaattctacaataactaaaaaaacaaaaattctttgtatttagagaatacttttaatttggtccttcaaagttatacgcatcacttcattagtttgattttttagattttgattactaaattaaagtttttaaaactcttttttgtcactactttaagtcatttttttgttaccaaattaatctttcaatttattttagtccttcaaagtggtttactttggtccttcaaagttatatgcatcacttaattagttttttatttgcttaaattttgattaataaattatttttctaaaatctcttttttggtactatttttaataaaaatttcgtataaaattaatcctaatttaggttacttaagcttaaaaattcctaattatcccacttaataaaataaatttttttattaacctagcttacttaaaatcaaacgggacaagttaaattatagttaatattgttgatattacctgtaatttcttaatttgaaattagggcttttatttttatcttaattaaattttataattaatgtgtttctaaggtctattttttttatctgaatcgaatacaagttagtatttgcatttcaaaataggaaatgatacacaaaattaagtatattgcaacattagtatagaaaattttaggtttagctgcagtgttttctcgcgaattttgttctcatatattttttttttgtgtgaaattttcctttaaaatttacaaaaagtcacaaattgtcttaaactacactggcataaaatttgtgaaaacataatttaggaggcaaaatttgcgaaattgtgtaactttggaggtataaaatacagtcaaaccaaaattttacattcacaatgtatgaagattaaacttaatttttaaaataccaatatactaataattcatataattttaaatgattaaattaaaaattatttttgtaggtagcgataaacagaacatttctgttctatctgtcattcttccagaccttcatttttatgttattttaattgaaataataaaaaatattgaatagtgaggattgtttaattaaaattcgaaataaaaaaatgagtcgacgtgtctcttttgacatatgtgaatgagtaatcgttatatttttattttacttcaaaagaatttcaaatttgtttgtataatattatttttatcaattaattaatttattaatttctaaaacttgaaaatatatttaaaatttgactattcttttattaagtcgtttaattatcaataatttaaactcaataattaataagtttttaatcaaatatagacttttttttcttcttaactttgtaattgtaacgttaataaagttgaaatattgagaaagtgagtggttggtcggtgtctattcaaacaataaacaatgtggcagtcacatgtgcattccgtgtggaccatgctttacagagtggaatggtcggttttatggtcaaaccaaccctgacttcaatcaacggctaccattcttcatgtctctgtagcaaatgtctgacccttgatgtaatccaagactttgatgatattgttttttacaattttgtattttttttataatttatttaattatttcccccctacaaaatcttgatctctctgctgactgctgttgtggagtggtgttgtgttttgttaatctcattcagacattcacagttatactctctctcttttcacttggatcactgatctcatctcacttttcaggtacttctctactctctttctcatgtttctactttattcccactatatgtatgattcagctttaggccaattagaccatgcttcattttggatttttgtagagtcggtatcttatattctacttaattgatcaagcattgacctcatgattctgggtatcttccattttgattactgggaaatccattgacaaaaagtaattacataaaaaaaatagtactacccttatatggaatgatgagttttgctgcattttttggagcatggagatctaaagtttgtattttgaatgatatgtttgtatctaatgctaatgcaagtgatccagaatgttacagtgttttcttttgtaaataattgatcggatagttaaattgtgactctttggttgactttgatttgttgtgtgatctgattggatcatgctcaagctaactgttgtgtgcatttactatctgcgatttagatatgtcgacatctgataagccagaagtggtggaaaggggtagcaaggatgaaaagcacaaggaagatgatcaagaggaggggaagggtggattcattgagaaggtgaaggatttcattcatgacattggtgagaagattgaggaagctattgggtttgggaagccaactgctgacgttactgcgatacacattccatcgattaatcttcacaaggcagatcttgttgttgatgtgctcatcaagaacccgaatccggtgccaatccctctgattgacatcgattacttggttgacagtgatgaaaggaagctagtttccggaatgataccggatgcgggtaccatccatgcacatggagagcagactgtcaaaattcctgtcactttgatttatgatgacatcaagcaaacatatgctgatattaaacctggaagcatcattccttatagggtgaaggttagtctcatttttgatgttcccatcttgggaaggctaactcttcctttggagaaaactggagaaatccccataccatacaagcctgatattgatcttgagaagattcattttgaaaggttctcttttgaagagacaattgcaactcttcatttgaagttggaaaacaagaatgatttcgaccttggcctcaatgcgctcgattacgaggtctggcttggtgatgttagcattggtggtgcagaactcaccaagtctgctaaaattgagaaaagtggcattagttatattgatattccaattaccttcaggcctaaggattttggctctacactctgggacatgattagaggaaggggaataggttacaccatgaaaggacatattgatgttgacactccctttggagcaatgaagttacccatcagcaaagaaggtggtactacccgtcttaagaaaaagaaggaagatcgtgattatgacgacaatgacgatgatgaggtacggcaatctacatatcctgttttccactttctctagaaaattacaaggtattggtatgcaactatgcatatcagcatatatatgcaggttaatgaattgaacgcatttgaatgttcaatcattaatcataaataacaaaatgtcatcttttttatttgttattgtgcatgcatatatatgtttataaggtaaactgcatggaagtttcttttaaacactggtggcaatatcttcctctatccctggcttcacagtctgagtggaactttagataccaacacaatcattctctactagacatatgagtattgttacattgctttggggagcttgctttcaattaacatatatggccattgtcaatgtcttgcatatttttaatataattgaaatgattcagaatcaagtattgtaaaactttatctccacttagttggaaagctaatagatttagtgaacaatttcttgtcttaaattttctatatatatgcaaaaaagttttatctgaagtcgtgctgcgcttccctaaactaactcttggtaatgtgactaagcaggtcaatctattttctttatcttcttgtataagttgtatttggttgtgccataacttttgtctattatctttttctctgcaggattgaagaattgtagcaggttattactagctattaataaaagcaggcattactttctgagttctgatggccaatttttatgtatcttgagagatcaagttgacattcaaattatgtgctattatcagtattttagtgaacacatgctgctgcagtccggcttgtgctctctcttgaaactttcttgttgtacttaattgatggtcatgacaagctagtgctgttttaatgtgagataaaagatcattttccttgaaactttgtgtgtggtcggttttatttattgtatctaagaggtggggttttgctttgtcattccggaattgagaattgactatggcttctttttagggtcgtgtcatgtgtgtggtttctattagcctgctgcgcctgctggtataaatcaaacagttctattgaaaagtttggaagtttgctcgtaccaaattaacaacatgaaaacactacaaagttttgtgcctgtcctggtctgagtattaagacaaaaagtgcatctacctagtaattgctatacatccgcaattcagagttcgaccatagagagaaggttctctcctagattcacatctattgtgccaaaatacctgtaattcttgattcaatgatgagcatatctgaaattaatgccgtaaggaatgatatttcaaaattgtaaactcaaaattgtttcccatgcattttacaaaatggtgtttttggaatttatgtctgattcatggagaagttcagaagttcacttttaactttggaagttagaaaatttattttcaatggccttggaaatgtaaaaagtagtaattagtttgtattactccctttcgactcatataaataaaaataaccaattacataaattaagaaaattagttaatatcatttagttttactaatctcaatttaaaaaataagattatttttaaaatatccttaattgaaattatcatatataaaagagtcattaaaaatataattagagttaaatgaatactattttataaatgataacattaaatatgataaaattagttagatttacttatgattaatttcaacatacaatatcattttttgtttatatatgagtttaaggaattagtatctaagaagttgtttagttaatcattcgctataaatataagtctctgaaaaaagagacacttcaagatagagggggttgtgtatttaagcagaagaaatacgagtctaggagatgtgagagatctcttatgagaatgaatattgtcattccttaaatcttgatcaacttgagtttataagatgatacatattaattacagaggttttttcaaaattggttataagacttataatttttttagataacagataattttgttgtagtaggtatcttgtcctgtttactatagagaagataaatagagtcgatgaagaaaaaaaaaaactagaaataaaagatgtttgattaaagataaatatagagaatagactaagagagatgagtaaaaataggtgaaatatgaaaagaaatgcaatagaaaaaaaaatttgaattagaataaaagaggtgtgagacacactaaatagtaaaaatttatcttcaattccctgtcccttcttaacaaccaaattaaactcaccccaaaagatgttgtgtcatttttttaatatcttttttatctatgatgtaatgaaagtagttttatctaacacagcgccacatgtctttattttgggtgattttgtttaaatttaaaaattaatattaaaataagtattttttatataaatatttttgtaagaaacatataagatttatttattaaataagcacaatttttttaaaataaatgcaatattttagacaaacacactaaaaaataaaaattatttattttattaaaataaacacttattttaaccatacgtttaaataaactggtactttatttggttttgaatattagcaccaaaattagccatgagttgatcacaaatgtatacaatttttttttttttttgaagagtgtaggcaatgtagactttagtgtccgcaatttttaagcggcgtaaattacatgactgcctcggaaactaatgctgatttgattcaattaatgaacaggtatattatactgtgacatatatccattatatagagaaagttaataaccatatatataatgcaaattctcgaatatagaattaatttaatatcgatctaaatattgctcgaaagccaatatggatcaataatatccttaagatattaattaagaaattaaaaagagaaatttttattaaaatatataaaattttattgtttataactttttttacacacttttacaattttcataataaatatttttttcttttaatctcttaatcaatattctaaaaatactggttagtaagactcataatctaaatatgggcccacctaacataaaatatttaatttttggaaaaaaagttaattaaaaattattattttagactctaattatataaagagaaagttggtaaaaaaattaacatatgaaacttgtagaatttgtaaactaaatacaccttttttttgctaagtatacccggtcactttagtttattttttttaatgaaaatattcttcatgaaaacgtgaaaatgcatttccattgattttgaaataaaataaaaacacatttatattgtatcgtgtttaatacaaaatgtatttccattttattgttatgaactaatataaaatgaaaacagattctatttttagtataaactcaacaataaaacaaaagtacattttcattctatattttgacaaacaaaacaaaaatatgttttcgttttgtgtaagttatttttttaaaactaatcaaattaatgatgacgtaaatgatattttctaattgaaaataaattaattatgatataatttatgatttttatagtagccaaattaagtatgatataaaatttttaattgaaattcaataaaagagaatataaattacctttataatagtaatcaaaataattatttaaaattatattttcatagcaattgaatttagtaaaaataaataaaaattgaattaattacgacacaaatttgtatcatgattaatttgattattattagaaaggataacttgctttaatttgacattaatttgttcaattaataaaaaaattcttttacaatcttaatttgattactcgtcatccatttaatttcaattaaaaagaacctaatttactcaattgaaatttgggagatcaaattggacaatttcaattaaaaagggaccattccatcgtgtatacaagtatatacaacatagaaagacaactatttgttgttttttcccccatatttagtgtcctatcaaaagaaaattgaatttggaaaaaaataagctggcaatattattcaaatgaagaaaaataaaataaaaaacgttccaatctcttccatgaatgtgaatataacattaacgagaagctgatcaacggtataaccaccaccttgtggtttaggcgtgacaaggcagtttgacttgttatgtatatttgtaattcttgtttcggttaattagatgaaataagctactaaaaaacccgttatatatatagttatgatttgttatgacaatgttccaaagtcatgatgctaagaaactagtctgtcacaactcacaccaactaatgtggccacctcaaatgagcaatatataaaaaagacttagtgtgaatagcttcatttgtgattctgatttgataataacgattatcattcattccattctagctagctactgtatttccttcttcaataatcttgaaacatccatcatcatggggacaaacgataccctattcagcataaacagaacaatttacagtagagttgtgttcgacgactacaattcagacccagacagaagattccttttctataatattaccatggacatgccatccaagatagtatccgatggcatatggggtaacagagattatggtgctttagtttcaagagcaacaatgccactgttggagatccaaattctctgcattttcgtcatcacgcaatgctttcatttggtgcttaggcgcctaggcttcccttatttcgtttcacaaatgatggtatgtatatatgctttgtccattctcctctctgttactgcatgcaggtctcatacaagaacatgcatgccacatgacatatttgtggcacaacatgttaattacatagaaaaacactattttctaatagcctttcatgtttgcgtatgtgtttaggtagaggcgctttcatgtttttattttatatatatgttctcttgtatctgttttggccaaactttgacactttttatgtcatttggtctttactaatatatattttttgcctataaaaaaactattttctaatagcatatgcatgcatgtcattgttatatatatatatatatatatatatgtgtgtgtgtgtgtgtgtgtgttttttaaagaaaaatcatataatatcaatccatatactatatatagataggattgaacttaggaataaataaattagataaaaagttggggtagcatatatagcaactttaagataaatatttatttattacatagattattgagatgaaactaattccttgtaagtgttaatatagatcgaaatgaaataatttgtagcctaacatgcaataaaaatgttaatttccaaatgaattggtgcatgcaggctgggtttgttctaggcccttctctgaagatagaggcattgagaaaaatcaaagtgttgttattcccttacgggagtgaagacgtgttgaacctagtatcagggtttggttacgcattattcctgttcctgaacggggtgaagatggatttcagcatgataacgagaacagggaagaaagcttggacaatcgctctttcgtcccttatgattcccactttcattggtctcttggtatgctacagtttgatggggcaggcgcaaaaagccctaggagagttcgatggaggaaagctacccgtgatagtaatagggcacagtggttgttccttccctgtggtagcttctctactctctgatcttgagatattgaactctgaacttggtcgcttagcactctcagcagcacttgtcatggatgtgataagccaagttgtgacaggactaggcactgctgttgtgagcagccttagactcgattctcatgatcattcccaagggaagggacctgaacttgcaacctacacagccacaaaatacttcatttttatagcattaacaattgtgaccgcacgccccgcaatgaggtggattgtgagcaacacacaagaaggaagacctgtgaagaaagcatacatgtacattgtgttcctcatgaccctttgcgcaggcttgcttggagtgtgggctaatcagactgtgttaggtgggatgttactctttggtcttcttgtgccagaaggtcctccattgggctcgcaattggtcaagcagtttgagatgatcaacacatggttccttttgccaatctttgtcacatgttgtgccatgaaggtcgatatttccacgcttaagagtggcaccttggttctcgttgtggtctccataattgtttctgtgcatttggttaagatgcttctaactgttggaatttgccggtattgcaacatgcccaaaacggatggtttgtgcctcgctctcatgttgagttgcaaaggtgtcgttgactacgtcacccacatctttctatttgattcaatggtaccacacaatatattagaataactttatttccttctcatatatatatatatatatatatatatatatatatatatatatcacaaaaataataaattaaagtatcctttttcaaaaaattaattgaattcttatatcataatattcttgaatttaggtattttatatttatttaaagaaaatgactgtattatatatagtccaagactatatgatcctaattaatattgattaacttaacgagaatgagattggtggagatcacatgatattaaatcatttgatccgactaatcttcatataatacatgatcttgaattttacaataattttatctttttttatgactaatattaaaagagatatagattaaaataggtaaatacttgtttaacttaactataaaactagctagctagtaatctaattttggtcctcatgcaatgcagttaatgagcaatgaaacagtctccgtgatggctatatcagtgcttgtgttgggaagcattgcacgcattggggtgaaatctctatacaacccagcaaggaagtacgcagggtatcagaaaaggaacatactgagcttgaaacccaactcagagcttcgggtggttgcatgcatccagaaaccaagccacataaattccgtaaaaaacgctcttgacatttggtgccccacaataacaaaccctttagtggttcacgtcttgcatttgatggagttagttggcagatcctctcccatcttcatctcacaccgtctccaagaaagggctatcccaagccacattaaatactctgaagatgtcattgtggcattcgacctctttgaacatgacaatgctggcactgcatcagttagcacctacacagccatatctccactacgtttcatgcatgatgatatttgttaccttgcattggacaaacttgcttccatcatcttacttccatttcacataagatggggcgaggatggtggtattgaatcaactgatgaaaacatgagaactctcaactctaaggtacttgagagagcaccatgctccgtggggattctcgtgaatcgaggctcttcttcttcatcatcatcaatgaagcaaatagcagtgatctttctggggggttcagatgatagagaggcactgtgcttggctaagaggaccatcaaagattgtgattgtaacttggttgtgtaccacttggtttctagccaaagtgaggtggcaaactgggacctcatgttggatgatgaggtgctaaaaagtgttcaggggtattatggtaccatcgagaatgtgtcatacgaaaagattgctattgaggaatcttctcagaccagtgcttttgtgtctgatattgcaaaccagcatgattttttcatagttgggagacgtaatgggatcaaatcgcctcagacagcagcacttgagagttggacagagttttctgagttgggtgtgattggagatttgcttgcttcctctgataccaatactaatgcttcaattctagttgtgcaacaacaacaaatgcctaagtcgttgtgaccaaagcgattcatatatatacattgtaatcagaaaaagttaattactgctccttttcatatacaaaaggattcgaatgttgtagctcatttttgtaatgatcagcaaaattaaataaaaaatttatgcaacacttttgtagatgctttctaatatttcaatacaagttttggtgaaagatcgaaaaggaattggattaaaaagtgttagtagaggattacatgccaaaataaaacttattatttgtcaactttgaacttttcttttgcaaacacatgaaactcataacaacaaattaaagtccattatatcatcattaagataaaatggaaacccataactacaaaacaagaaaaagcatatccattgaaaatatatatcatagggtggtttacatatagttgtgcagatataaaacacatcatagtcttcaagctccattgcaatcacaaaccacttgatttgctcttccctcctatatatggaagttcctatggcagccacatgtagcacaagtcagagctgcatcagtgccttccgcaccacttgctacgaactccctgcagccatccaaaacatatcttccaaccctacacgcatgattccttcggcactcgctatataatggattgtgtgggcatctcctgatcattgtatgttatccttcaaattctctaccttcaactgcaaagttgttgtaaaaaataattgttagtggagaattaaaattgtagcctgagttacaaacaaatcataaatcataaatagacagatagaaagaaaaaatgagagacagagatagaggcagtgtgtgtgagagagagagagtacagcttattgtgtaacgggtatgaagagccctaacaataataaaaggagtattatacataatgactagtctgatctggatccattttgaagtttaaaagtaatttttatatttgagtcctagtctaatatagttctccccttttctttttattcttttaactttttaaattgcaaaaattgttaactaaagtttaataatcaagcaaaattttaattctttcaatcactatcttgcattatagttgatgaaatttaatgtataaaattttattttttaagatattcttttgacaatgacaataattacaagtattattattttataaatattgcatgcatgtaaaaaaatcaatttttaatatagtttaatacatctaatatatagggcattaattttttgttagtatttaactgttaattaaagtgtattaatcaagcaatttcttcgtctcacttaatggcaattcattcgatcactatcatgcaacataatttatctcaaattgaatctagaaatttctaatttttaattcttttatacaatgaacacaattgaaaatattattaataaaattctgcaaacattacatgcatgtaaaatagaataatttttgaaaaatgtaatacttctaatagggcattaatttcttttgtttcaatgttaacgcaataatatttctttcaattaattattttttaaaattctcaactattgagattcaaatataaaaaaatgcaaggtgatttcaaatattaaatttgttcacacatatatgctgtgaacaaaataaagtaaatggatttgatatatatatatattataataataataataataataataataataataataataataataaaggaattaaattttttataagaaccaaatgaattaatatttaactgaatgtatgatttcatcactatcattttcatcaaacattttaatttataaatcacactatttttatgaaatttaatccctatattattattcatttcaatgactttttttgttcagattcaaagtaaatttctataactttaattttaaatgagtaataattaaactagcttgtcaaataattttaaacaatatctatgtataaacatatttttaaattgtgttatcaaataatataataaaatatcacctaataattttttttatgattttataatcaaaattaagagttcaaatgaaccctatggaagttggcagccataggcacggccatcgggcctttgatgtgtcacaattactaaacaagttggcttgccatagccacagtcgtgtttttttttttcctagcatacaattactgaacaagtatttattacatttactaataaattgagttcttacataataaaacgtctatatgcaaaggagggaatcattttgaatttgatacatgcgtttggaaaatcttagcagttactatatgatgctcactcacatcacgttttaggtaaagttttcgaacaatcacttcggtttcctcgggagctacttgacggtttggcaaagctttgctgtgaagctcacgtttttggtcaagaaccttcacatgaagacagttttcgaacaacaaccatttcagttcgatgaatttgttacatcggtttccacaaagatgctcattcattctcatgcatgtcggattttaggtttaaaagctctctacatgccggtttcccggaaaactttgatggttgggcaaatgaaacttaccaatgatgctcacgttttaaggcaaagagcctcacatatagacaaatcctcagtggcatcatacgttatatacgtgaaccccacaaaaactatgttttactataagtaacgttttagttcaagagcttcacatagagacaatagttagtggaatcttatctgtgcactcccacaaaaactgtgtgctacttcaagtaacgtttagttttagtctcacaaaaactgtgttttactataatttggtggtccacagtgtgtgttaggattaaaactgccttgaaactgatcacgaattgggtgaaagctagcctaagcctggtatggcttatttatttcaagctaaagatgaaatttactgaaccattttaattttactgagtcctccaaatggaaatcgatcttctcgttggctagggattaattagtttcttaaaaactcacgcgttcaaattgattttttttaaagaagagttaaacaagcagtaaaaaatacaagacttaattggacaagtttttttaatacaaaattttgtttttattaacaaaactcaaataatgaaaaataattagtactattaaagcacaccagatttaggcacacgaatataaaaacagacaagttattcttttttatcatatttattagcacccctatatatgaacctgaaatacttcattttccacacacacacactcacaaaaaataaaatgaaatacttgttcgaaagttgtcctgtttatctttagtaattgtatatatattaatatgctagaaacagttttggtaattgtatatactagggtgcagaatctttgtagcctattattataaattatgtttatttattgtgaggtcgaaatttgttattaaattacttggtttagaaaattaaaaatattaactatagtttatttttattacatgaaataaaagaacgttactaaattgagtatatgatgtagttaaataaatttaatatcttaaatattgataatttatattctttcaatttaatttagatttcagttttttttaaaataatttggagttaagcttttaaatacttaattacaacaatattttaattgaatacattttgaattatttattaaatactttttaacatatattgacattgtaaaattctgtttaaatttttttatcttctaaaaactattattaaaaaataatataaaagtttttaagaattttatctgtagtaactgatacttaaatttgtttaactaatattttgtttagtcctaattaatccttaaactttaccctatttgcaaatatatggtcgactttattttcatttcagttgatccttaaacttttttaacgtttatgcaaatagaaacccttaaactttaattgcattctaattaattgttaaaatttatcctttttacagatagttatttctatcatagtggagttaaattatttatcttaaatgtcaatcattgattaatatttttcttcttttgtgatactgcatgttcattttactatattaatatataataaaaaaaaggaatttagaaagaaaaaaattaaacaacctttattttatttttcaattctatattttattatattctgctatttggaaaatgatttataaacatataattagtaaatgattgggatttaaaataaataaatggtttggatttcttctttgttactagtttaaccccaaattaatataagactatttacaaaagagaaaattttaagatgaaattcaaattaaagtgtttgtgtgcaaaaaggataaagtttaagaataaattggaacgaaattagagcttatggaatctattttcaaaaagataaaatttaaggatcaaggtagaataaattaaattaaagttttaggttgtctatttacaaaataggtaaagtttaaggtaggtaaatactttttcctcgtagtctcaagatttttgactattactatgaagatatcttaattttttttaaaaaaaaattaagtaatttttaagccaaaaaaaaaagttggcccaaactaataaacaattgttactaagccaatattgctaaatttggacatatatttcttatggaaggaataattttgtttgaaacctacaaggatatcaacaacaaggatcaacaattatagttaaaaaaccacacgacagggtggagttgatcaacaaatgtataaaaaaggcaactgggtctcatattctcaaatatcatatagagataagttgttagaaaattagcaagagcctctattgtgagacaaggagaatttcatcattcaaaatcttgtgacaatcgaacacgaatttggaattgggtattacaaaagatatacttgggtgagagttgcataaaagctatgtagtaaaaatatacttcaacaatgtcataatttatacgaatatacaacatcgattaaattacttgttgcacgacaccaaggagtaaggtggagacgatgaaattctgatagagaatgatgatgcaaaatttaggatgtgcacaaagatgcaaatacaataggtgggaaacccatattatctaattttgactagttttaatttattagacttatttaaatgaaaattagtaacatccaacactcaaataaccaatgaaggttgggtctaacgaaagaaaatagtgtcaaacatagtggtgaaccaatgttagtgtccacattagaaaaaatattcatattttgtatctgatcatatctcgaacatgattatcttgattatttttcattacattagcttttaagataatataataatatatacatcttatcaatagaatacatatttaccataaatatgagttttttccatacagcggacttaagaatcaatcctctaactagtgtggaaataaattctaccattcccatgtcttaaaaaataaaatgtaattaattagtattactataatataagatatagagtgaaaggagtaaaaacgtgattctggttgttctcttgtcagttacttttataattacattacaaatggatctaaataagattttccctttataaatagaccttcaagggttagggctcttcacacccattacacaataagctgtactcactctctatctctctctcttgctatttgtctatttgtgatttctttgtaactcaggctacaattttgattctccactaacaatcttgactttgtaggtagagaagttgaagaaggagagcatacaatgaggagagttttcttgcgcagcgatggaagtgctagatgttcgaacaactcgtctgtgacgattgtgaggcacgtgagatatcgcgagtgctgcaggaatcttgcatatagaattggaggaattgttgtggatggctgcagggagttcgtggccagtggcgccgaagggaccggcggagctatgagttgtgctacatgtggatgccatagaaacttccataggaaggaagagcaaactcaagtggtttgtacctgctcttctcaccctactaccagtactggttgactatgaagactttcgatcatgtgttctatgtgtttgctgaacaattcttcttcatcatatctaaatctatcctatgttatatgttttctgtggatctagctttaatttgcttgtttagtttaactttatggttttttattttcgcttaatgatatgatgtaatggactggtgatgttcttcaaatctagtgtgatacgtatgaaatttatgagtttgaaaagatgtttttcatgtcatctaagtaactcttttgtggtcttgtatacaagtttttcccttttcgatctttcattaaaattcactttgtctaaaattttgtcaaaatcattactttttaacctctaaaaaaatgccacttataaactaaatcgatcaaaataattatcaaatacaatgaaatcgaaatcagaacacacaacaatagaagaaaattctcgcaaggtctttccaaaaaaaaaagcattgataataataaatattaaaaaaatgattgagtgttaaattgtatgaggaatgttcaaataaaaatatcgttaataccttaattcaatatgttgtaactttgagtcaaaatatatgttaatgttatcaattaatttgaatcaaaatatatattagttataattagcttaattaaattaaatatttaataaaattgaatgattgaatgtttaaatcatgaatattgttaattaccttagtttaaatatatatgttgtaactttgaataaaaacatacattagcgttattgattaacctaaaaactaaaaatattcaaggtaagatgaacatgtgattgttggtttgaatgaagtaaaactctaattttttaaacaagatttcatgttcaagttccaaaacaatgtaattagaagaatagatttcacttgaagatgattatataaaaaatttcaatagaaaatcataaatcaactaccattttatataaagttaaaatcttataatttaattatttgattcaataaatcttacatttatccgatgaatgttgaaaacttaatttatctttacattaaatatatttgattttttaaccttttaaaaatttgtacatcaacaaaaaatagatgaagtaattgtaaaattaataaatggtaatttttttaccatttagcaaactgtgtggatccaaatgaaatttatttaaattctttaaaaatattcattagtttgatcttgaaattcgtgtatgtgaaaaaaaaatatcactaaagattttttaatcaaccaaggtatttctgaccataggtaaaaactaatttcttgaaatattaatatctatttaaaaggttaactttctctatatttttctttctttcatacaagcgaacttaagaatcaatcctctaactggtctggctttaatgaaaaacataagaaaaatataaaattctagcgcgcatttccatgtccaaagaaataaaatattacattgaatggttctgagatgttcttttgtcatttacttacaattcaaaattggcacagctcggacttagtcaatttcaatataccttctagggttagggctcttcatacccattacacaataaactgtactctctcactgcctttctctcttaatcatctctctgtttatttatgatttctctgtaactcaggctacaattttgattatccactaacaattaattttgacaacaactttgcagggtttggaggatagcataccatgagaaggatggttctcatgggaagaaatgggcctcaaagatgccaaaacaacgcattagtgacaattgtgaggcatgtgagatatcgcgagtgctaaaggaatcatgtgtgcatcttgaaggacatgctgtggatggctgcaaagaccacagagttcataccaagcggatccgaaggcactgatgcagctctgatttgtgctgcatgtggctgccacaggagttttcacagaagggaagaacataattcatttgtggatgctcttctcatccttctaccagtaaagcttgaagactataatatgcattttctatggacctgcttctatttccttgttttgttgttatggttttggattttagtttaattaatgatgatgtgatggacaggtattctggcaatctggcaatctagtgtgatatatggtttcatgaatgatgtttgagaaaagcaaagttaataagatgttttaatttggtgatccgaagtgcaaagacgatgaatgataatttattgttctcttcatatataccctatatattaattaaaacaatattttgggtatatctctccctccccattttttcttttttcttttttctatttttctttctatttctatttataaataattataagttattttttgaatttactaattggctacaaattaaatgatttccagtaaaaacatgattaggaagttgttctggttaattagctttttatcatttctatgtcttttttggatgcttattttgaatttactctgaatcgattgagtatgtccaatagaagatttcattttgagacctttgacattttttttttgtagattttaatgtatcacatcattctcaagatctcttttattttttaatctaatagtatatcttattttaagatcttgaactattttttgtagaacatatttttattctaatagtagatcttattttgagatcttgactgcaaatttctcttaagtaaaaggaaaattctatagaacagttgtaagattggtatatggagtagaatgttgggaaatacataggcaacatgagcataaaataggggtagcggaaatgaggatgtgtgaatatatgaaggtggataagataagaaatgaggatattcgacaaaaggtatcagtgatatcggtatgtgaaaagatgaaggagcatagattgaggtggtttaggcacgttatgaaatgaccactggatgctcctgtaagaataaaagtttattaccaagagctcgacacaaagagaggtagaggtcgaccgaaacttatataggaaaaggtagttaaacaagacctaatgaaatgagatatagattgacggacggtatgtcttaggacggagtggagaaaaactataaatttggtagagggtttactcattagtagttctatgttccagtcgttcccttgttttagttcttttcctcttttttttttcccttcttcctttcacccttctttcattttagcttattttttctctcttttgtcttattttcacttttctcttcccctctctttctctttctttgtctcatttgtgatttatcattaagtttatctaccactaatcctaattaatttgggttaaatatactgttaatgttgatgatgttaaatcattttttgtagatactacaagaattagatgcaaattaaccttgtggaaagagagggtaaaaaattatctttttaaaatgaatgcagatcttaatagttattttacaaaaagtagatcttcacacataaatccaacatcttactccaataataaatcttattcatcttaatcttaatatctgcttaaaagatttgttattcaaaatgctatgctttcaaattatactaatctacacttgcattgctttcccgatctatgcttattttctttttcctagttttctataaacacccttgaatcttaatttgtaccattaggacgaggttgttcagtaattcattaagacttttagatttacatatgttttttttttctttctctgaaatatgttggattttgattatagtctttaataaaaaacttcttgactttaattagtctcaaaataaataactaaatattatagatgtaaattctaaaattaattaattataaatatcacaatagttaatatttttaatactataattttaattttaaaataatcatttaattttttgaaaattaaaatattcttaatttttagtaatgtttgagtccgttaaaaatgattgccaatgaagtatatgaaaaagtgagttgtacaaaaaccattactctgtttttaataatcacaccatctcaattagttttttaattaaatataaattctctaatttagttttttaaatttaatttattatagttctttaaaaataaaaactctacatgtcattggtttgaggctaggatctcttaagtatcaacttcgagccttgacttgaaaaaaatatgattaggagggcatatttattaaaactggtaagttggattcttcaattaaaaattaatcattaataaaattgatgaatatttcacaataaagttaactgttattatggcttaactatgttttttttgtttctattagcattttttcatttttgaacactaagtttagttttctaattttagtatacttgttagttgaagttttttttcaattttagtcccaataggatattttactcatttttagtttctaattgtgttttattaaaatttttcatttataatccttataagtccacacttgtaacaacaaaaattaaaaagacgcaaacttataggtattattattagaaaaatggactttcaagataaaaaaattgtaaaaacactaaacttacataaaaacatatttaaacccaattaatattgttctatttttatgaacatgaatgtctagcaggattgctagtacattgatgttggatcaaaagttctctctaaggtatttatgggagaaatacctctagaaatattgatcactatgcactttaataccaaccaaatggaggtgagatgtgtgcacaatgctaataaaaaagtagagtagagagaacatgtacctttttccatggatgtaacccttatttatatgtaagttacctccagatcagttgatagtgctaatgaaaaagtagagtagagagaacgtgtacctttttccgtgaatgtaacccttatttatatgtaacttacctctagatcagctgatgcttctttccgatttgctcggctgaaatctataactgttgaagtcacgatatgtgtttgttgtgatcctcttcactggttgttacgtgcatagtttaggtctccttgattgttattaagattctgaaacaataggcttttattagacctcatcatattattaggcccgtatgctaagttggtaacaaatactaacccattaaaaccaatcaatcactattaaaaagtgttatatgcatgaaaggacgactcactgagatcagaagaaatttacagaagtgttctatgaaaattttcttttgctgatacttacaaaattgagctacaacattgaaatccttttgtctatgaaaataatcagtaattaagtttctggttacagtatatatgtatgtatctctttggtcacgacgacttgggcatttgttgttgctgcacaactagaattgaagcattagtattggtatcagaggaagccagcaaatctccaatcacacctaactcaaaaaactctgtccaactttcaagtgctgctgtctgtggcgatttgatcccattacgtctcccaactatgaaaaaatcatgacgatttgcaatatccgacacaaaagcagtggtctcggaaggttgatcaatggaaaccttttcgtatgacacattctcaatagtaccataatagcccttaacactcttcaacacctcatcatcgagcatgaggttccaatttgcctcactttggctagaaactaagtggtacacaaccaagttacaatcacaatctttgatggtcctcttagccaagcacagtgcctctctatcatctgcaccccccaaaaagatcattgctatttgcttcattaaagggctgtgatgagtagaagaagaagagcttcggttcacgagaatccccacggagcatggtgctctttcaaggaccttagagttgagagttctcatgttttcatcagttgattcaacagcaccatcctcaccccatcttatgtgaaatggaagtaagatgatggaagagagtttgtccaatgcaaggtaacaaatatcatcatgcatgaaacgtagtggagatatggctgtgtaggtgctaactgatgcagtgccagcattgtcatgttcaaagaggtcgaatgttacaatgatatcttcagagtagttgtggcctgagctaagcctttcttggagacggtgtgagatgaagatgggagaggatctaccaactaactccatcagatgcaagacgtgaaccactaaggggttcgctgttgtggggcaacaaatgtcaagaacattttttacggaatttatgtggcttggtttgtggatgcatgcaacaacccgaagctctgaattgggtttcaagttcagtatgttccttttctgataccctgcgtatttccttgctgggtcgtataaggatttcaccccaatgcgtgcaatgcttcccaacaccaacactgatatagccatcatggagattgtttcgttgctcattaactgcattgcattagaactaaaattagataacttttatagctggttaaatatgttttgtttacctatttttagtcatatatattagtcctaagaaagaaaaatttacttgttcaattcaagagtacatggtcttggccaatttccacataatacatatagtaatttgaaaatgtgttatgtgaagattcatcgagatcaaaacaatcggcatcacctgatcattggttaatttaatgagtattaattattgtataatgattgtacaaatatttaacatgcgtgcagttttttaaaattaaggaaaatagttgaaaataaaaagagagtgaagtgagtttacgtacaaatgaatcaaagagaaagacgtcgttgacaaaatcgacgacacctttgcagctcaacaagagagcgaggcagaaaccatccgttttgggcatgttgcaatagcggcaaatcccaacagttataagcatcttaaccaaatgcacaacaacaacagtggtaaccacaacgagaaccaactgggaactaataggcgtggaaacatcgaccttcatggcacaacacgtgacaaagattggaacaaggaaccatgagttgaacatctcaagctgcttcaccaattcagagcccaatggagggccttctggcacaagaagaccaacgagtaaaatcccacctaacactgtctggttagcccaaactccaaacaaccctacgaatatggtcatgagaatcaccattgatgtgtatgttttcttcacaggtcttccttctggggtagtcctcacaatccacctcattgcggggcgtgcaatcacaatcgtaagtgtcatgaaaacaacatattttatggatgtgacgagtgcaagttcaggtccctttccttcacctttatcgtgagaatcgagtttaaggctactcacaacagcagcgccaaatcccctcataacttcggttatcacatccatggaaagtgctgatgagagtgctaagcgtccaagttcagagttcaatatctcaagatcagagaggagagaagctaccacagggaaggaacaaccactgtgccctattactatcaccggaagttttcctccatcgaactctcctagggcttgttgcaagtaccccatgaaactgtagcataccaagagaccaatgaaagtgggaatcataagggacgaaagagagattgtccaagctttcttcccagtttttgttatcatgctgaaatccatcgtcaccccatttaggaacaggaagaataagtacccaatccctgttactaggttcaatacgtcttcactcccgtaagggaacaatatcactttgaatttggtcaatgcttctatcttcagagaagggcctagaacaaacccagcctgcatatgcaccaattcatttggaaattaatttacatatatattgcatacttggttacaaataattttatttcggtaaacacgtaaaatgaattgaagtttcatctcaggaatctatggaattaaataaatatttatcttaaaattgttatatatgctaccccaacgtttatctaatttatttattcctaagtttaatcctatatctatatggaaattgtttcatggacatctattgtactgtgagacagataaaaaaatatagatataatagaatttatgatgttttagaaagaaataaatataaagaaatgagaggtgttgatggagtgtttaaaataaatgagtgtttattactctattcatatatatataatatggattgatattatatggttttccttaagaacatatataacaatgtcatgcatgcatgcctatgctattagataatagtgtttttctgtgtaattaacatgatgtgcaatatgtcatgttcttgtatgagacctgcatgcagtaacaaagattggagaagggacaaagcatatatatatatatatatatatatatatgtatgtatgtatgtatgtatgtatgtaccatcatttgtgaaacgaaataagggaagccaaggcgcctaagcacaaaatgaaagcattgcgtgataacgaaaatggtgagaatttgaagctccaacaccggtattgtggatcttgaaagtaaagcgccataatttgggttaccccatatgccatcggatactatcttggatggcatgtcaatggaaatattatagtaaataaattttctgtctgggtctgaattatagttgtcgaacgtagcattactgaaaattgttctgcttatgctcaatagggtctcgtttgtccccatgatggatgttattgatcaagatacagtagctagctcgaatgcaatgaatgataatagttattagcaaatcagaatcacaaatgaagctattgacacaaagtctttttatatattgctcctttgtggtggctagcaacatttggtgtgagttgtgacagactaatttcttagcatcataatattggaacattgtcataacaaatcataactaataacggttttttcatagcttgtttcatctgtaatcgaaacaagaaatattaaaacaactatacaataattgtaagttaaactgccatgtcaaacctaaacccgaaggttgtggttataccgttgatctaaatcatcttctcgttaatgttatttacattcacggaatggattaatagggactttttcattaatttgaatagtactactaccagaccattttttttcaaacttcaactttcttttattagggcacttaatataggggaaaacactaattagttttctttctatgttgtatatactatttaataattatataacacaattgataataattataattaaaaaaatatataattaatgttaattcacctgtaacttgtaaatatgcgaatctttttctttaaaatacccaaatcttctcaccactatatcagtgacaattaacacttaagtaaatgaaaatgcatgctttatttactattttttagataagcatgctttatttattttatttctaaataatcacaaagctaccactagttttgtagtgaaaaaggtgaatataaatggcataagaatagtaagaattaacaacaattggtcgcatgaaaggtgtgaaatataattgaaaattgaagcatcagtcaaatgcatgctttaatatttttcttggtcttatgcatgaatcaaatgcacgttttggaaacgaatataggaatttaatatcagcaattcacgaaaaataaattcaccattttctttgtataaatagccagccagctctagctttcagtcatatcctagctaatagtaacttgaaaccttttttaagctttattgtgcattatatctctactattgtgataagtttgaatcatggataggaaagctagtggtgaagttagcaaaggtgaagtccccaaacccacagagaatgttggaagtggttctgaagataaggttatgaaggctccaggtggagatggatcttatatttcgaggaaggaatttgagaaaaatcctcagggttactttgatggtctgcatgctgaacacaagggcaataagtagttgcgtgagatttttgtttcttggtgaatatggttgctatatgtagactggtcctataataagtaataaatcttatctatgttgcccgcaacaagaaataaaataaagcagtctacttagttattctatgaatttctatatatctctgtactaattctatcttttaaacttttgtggtgaatgctattattactaggtggtgttaactctggagagggtgagcactgagcaacaccccttttgaaccccgttttaatatgcaaaagttttgttaacaacgctcttggaaagatgttagattgaataattcactcattaatgagcttagcttcttaaaaaattaaagaaaaaaatagttgaaccgaaatattctgatatcaccaatgtagcacacaaatataaataaatttgaattaaaatctttaggtgcaagatgtataattgatgaacatgttaagcatcttgttagatgattttgacccttggtttatgagggaacaactattattgtttttaaattggaagttttgtgtttaagtattcgcttaggggttcaatattccttaataaacattacatttccattctcctcttcctctccttcatccttccagcggcaaaacaaacactacaaaagattagttaataatataattatatttacctttttcattaaaactgatttttgttttttattcattaaatttaataatattatattaatgaagcatttgtaaactacttgataagaaattagcttcgagatgtgcaataaaattaacgattaattaaatttttagtccctgaaggtttttagcttccaatttttagcccttaattttttttttgataaattttagtcttccattaattttttgtcatcacttttaatccttgtaaattttttattcatttgtaatccctcatttatttttattacgtaaaattagtctctaatataaaataaatgagggactaaaaataaacaaggaacttaaaataagaaaaaaataaaattagagggattaaaaatttccaaaaaaatttgaaggactgaaaattaaaatctgaaaaaattgagactaaaaacttatcactcctaaaatagaaaagaaaccttaattattctcgcactcaattttccacgctttgtagttcacatcagtttaaataagagataattccaaaaattattgacactatttttttttttttaatcgtagggaaaagatagtcttgtgtcacaaacagtagatacttgaggcttctttttttctttgacaaaggaatttttttcttctagtttttctcttttgttataatcgcatgcacaacaaacaatattttacattactgatatgtgcgtgtagttgtatctgcctcttaattaatatcggtccctttaaatttatttttcatttcatgtcgggataagaaaatcaaaaagtaaatatttgaaagtaatttaaataaattgtcgagaaacgtatggtatcgattgtagttagaaattaaagcagttttcttttaatttatttcttaattgctttaagcttgtatggaaagatacagtcacgcacgtgatttgatcagaagactgtgaaaagacatggacaagatacgggcaagcatcatattcaattgttgtccaactctaaacacaatttgttgcatacacttatagctccacaaaaggcacaaaaaatacgttataaataatctaatgaggttacttgtaggttaattttttttttgttttttttataatatacatgttattttaaattttagatactttttttaaaatttaattaaaaataatgatatttaaatgtttttgtttttatttaatttttaaaataatcaattatctttatatgtttttgttgtaaagaaaaaaactttattttttaatacaaatattttatttcctttttttataaattttattgtgaagatattacatttttcttttttttaataaaaatatttgagtatcatttaataattttttcttttgtaatcctttatttctattctaaaatttgcaagttattacatttgtgattaaatgattatcaattgataacttgaattatgaaacaagcaaacattctttcttctatcgttaattttcatattaaatttttaacattttttgttcttatgtaatattttgttaacagtttttagtctccactatatcaaataacaatataactgatgaactgataaccacatgacctaacattattaatattttgtataaaagtaatactaatatataactttgtctgatgaattttaatcatccccccccgcccaaaaaaaaaaaacaaatgttcaattctgccttccctgagttgtgacggaaaaggattgaacaccaatcaaaaaataaccagagacttgcactagtagccaaaaacggagatgagaatgttatctagagtacttactttcataagcaagaagatcaacatcaacattacctttaatcctaagttacttttgcgagcaaatgaagatatattatcccttcataaatcatttgtattcaattgataaaattgtcaaaagttatcataatatgatgataaaatgtaaccatgtacgaagaatatatgtatacattcgcgacaaaattggatttcaaagtagcaagagaaacatcattgaaaagaattaagaatagtaagctaaaatatgctactggcggttccgacttggaagcaagcagtcaaatgtaaccatgtgtgatatcacagattccttgtgtgcagtttgtagtctaggcttggccaaatctattatatcctcacgcaaactgttcataattacactgatttagcaatctcaacattcaaaaaaatcacattcttttcatgtgcttaaacagtaagaggatataaatatgagcctgttaaacagaaagtaactagacaattgtagctgagaattgagagagaagagtgcaactaaccgttcccactctccggtagcttctgcgtgccacttgacagactgatacaggcgatccaggctatagagtgccaatccaaacatatattgtgcatctctctcctgtagataacatgtaacatgacatttctatccttggtctatccatctcattcaaatcaactaaataaaatcaacaaaaaggaaagctacttaccaacccttgatcaacataattttggtactgcataatccttttcttaacctctataacaagtagcctcctctgaatccgagcaactctacctcttccctcagctttggtatcctaatttacacagatttttttttttttttttatcaatgtaagtaatggtaatgatacaagttgacaaaaaaaagaaacaatttaccgtggtaaaactccaattctaattggagaatatcacaaacaccacctaaggaattatatctaagttctgtccatgctaaatccaagccaacttactttagaaaatcattggaaattatctcactaaactataatgagtaaccaaatccattgaaaacagaataggtaacttcataacactgtagcatccaccaatcaatacgaggcaaataacaaaattctatacaaaaaaaaatgataacagtcaagtataacattagtggacaaagaaataaaggatgaaattgagcagatttggtatcaaaaaacatctttttacctaacaaataatagttaagacataagtaactagaaacaggtgatgtaatatctagtccactatcacatataaacaaattttaacagtatccctacacatacactaaaaattagtcaggagtgaagagattaagatttagcaatatatacatactgtaacttgcaagcatatccccgccccccccaccccctctcttttctttcccaacaatcttgtcaccaatattcacttaatcacttcatggagtagggtgtcactccaaacaagattcacactccaactcagttgatatagtttttctcaagagttcaatactatagtatgatatttggagtactatcttctttaagctcatcattttgtgccaaccaaccaagggaaattacctgtttgaaccatccacgcactaacatcataagtaaaagagagaggaaaaatgccggtaaagcagtcagaactgcaaagttgatttcatttgcccgtagaatctggttcagctctagcattgccctgaccaaaatattatcttgaggaattaaaacaatgtgaaatatttacttaaattttcagattaaaaaaactcacgtctcagtgtctagcttgagcttctgaacctggaacagtgaaaagttacgttaaaactactaaaccagatgttacatataagatataacatatgaattacattacctgaataagtatagcccgaaccagctctccattgagaaggttttgaataggatgcatgagttccttctcatacctgcatttatacttgaaaaaattagatcttaacaattgtgataaacactaaaattacaagaaatgaagtgatattatgaattttactaataaagattctaaattcaataattcttgatattagaaaatgataagcccctaagcacttggggaaccgtctttaaaagctagctgtcaaggagggagaaccaagccacatgtgtactacaccaaacatcccatactactcaatgtgagacttaggcaccacataatacccaagtccttatcttagcactgccctcgagagccgaagtcctcgtagatagcccttctcgagttgacagccagctttaataccaattggtaagcacccaagcacttggagaaccctcttacagtggggggtggaggccaagtcacttaaagtactccaccaagcatccatactactcaatgtgggacataggcaccccataatacccaagtccctatcagataatatagagaggactaatatatataaaaaacactttctgtatgttattgtccttttgttccatcaaaatccaatttttaattctgcaaagttttgaatattgtcaatcaatgtaaattgaaaatattttatatgaatatccaggtaaggaatttagattgttctaacatggacatccaatatcagaaggcaacttaaaaaatgaacaacccattatcttaaaattatttgactataaatgctcacatatttccaaccccaaaagataccgctagttaaactagaatagttaacccacaacataggccagaaaccccttagtcaaaagatacagcagtacactcatttaatgtcaatatcaaaccaatggctttctattaaaaataacacatcttcatgatgaaacatcaaagcgagaagaatagctagaaattctatagagcagtgtcttcattccccagaagtcattggcattgagaactattttagtactaaatccagaaaacaaccaagctattaccaacatataatgaaccctacaggtataatatgaaggaaaatggctcacaagcaaatccatgtatctatttcaaattcaattccataagtaccttactaccataagacaagtataactagagatggttctaaagtgaaatatccaaactcacctatccatgactatctccatcatttcctgatctgaagctttcactgggaacttctgaccctttgtctgctcactgaaagccaacaacattctgtacagaaatttttagaaaaagttacaatgaaagcaatatccaattatccatgcaacaagcatgcctttcaatttcaagtagatgagtattgtcaatcaagcttaaagcaatatccatgaatatgagtaaatgcaattacaggtagtcataaaaaaaatgaaataattcatagtatgaagactagatatctctaatatatccttactgctaactgctaagcatattttatcttgttgctaataaatccaaattcttcagacagatttaggtggtactggattgtacttctacttatggtattagcatatgctagaaaacattgtaaaagataatagtaggtaaccagactacactgaatcaacaggattagaaaaattaacatcctgcatttaccgcacagcttctattagttgattttttttcctatttcttttcaaattagatcttctacatacagaatcagcttcaattcaagccatggaagagagtcaacacaactcactaaaattttcaagtcccaaaagtttcacaagcaattattaaggtgcctaattaacagcatatattgcaaaactgtaaatagttatgttaaattaaacattttgtaatgataaaaaaaaattaaacattctgagcattaaggttcatacaggtttagtattcaaaaataaaaaaaggcggacaacgtatttaaaaaccaataacctgtgtagtgagttggaagttaactgcacctcttcaacgtccataataccttgatgtctcttcttgaatgtatcaaaaagttcatccctaatggacaaaatctgaaaaatgattgcatcagaatacatacaaaagtacaattatgacgcaggacaaagtgacaagcaagaggactcatatctcaatagtacataagatttttatgtaatttttatagagattactttaaagggttttatttggtttcaactgatggatttaacccagtcaaacgagtactagtgggatattgaatagaatagaataatttaagggctaggcttaattttaaaacaacaaacaacactcttcctagctttataatacattctaagaactttccttttttttctgggggaatccaaccttatatacatattacatagaggcatagtgcactttagatcagcttctagacaatattaaaccttatttcatgcttccatcctacatcaatttgtaaaccttaatcagtttggttcactttcaacagatttaaaaatgggaatgaagagggagaagatagaagaaaatgaaatttcttcattgctcatggagaacagacttttacgaagggtacatagttaattctaattattatagatcgagatttaagggaaatgaggttaagaaaattgaataatgctgatcacacctatctcataaggatatgttaagttaatttctcctatattaaggagggggaaaaaaaaaaagaaaaaagagtgaaaccatagtaaattatcaagaagaaatgtaccggttcctctacatgattcttaaaaaagctatatgttgagttcctagcttcctcaacccaattatcaagatcagaactccccaccaatctactatgccgcaagagccaaatggagcatactgacaaaccaactgcaccacatgtatagcggatccaatattgagttattttccttggctttttatgtttgatgacctgaaacatattacaaccataaaattgaaatttaaaattttaatgatattacttaacaaaccaatcaacataagctggagtgctggacaactagaaacaaatatgtattattaaaacaagttgattaattgttcaatttcagaacctccatccacaaatgactaaatccaatatatatggtcaaaaaatagaagcccaagttattgactccagtcaagataattttgtccacttctaataggcattgacaaagtcccagagattggcaggagatagagacagtgacagtgaaaataacataatatagaagctatatcatgaatattagaccatatgatataggtaaaaatttagacagtgacagtctccaaaacttaatcaaataacataatatagaagctcttacaagaaaagatatgtatgaatccaacttgtctaaattttgataaactgaattgatagcatctcttatttcacagtctgtccactgagaccccgcctgatttatttctggcaacttctcaaacagcagaggggttgaatagctcccatcaacagaagaatcactctgaataaatagaaaaggtcaattctagaaacaatattaagctgcaaacatgcttcagttttgctttacaaaccatggtacatagagataaggggtaagagtatacataagggaaaacagaggcaaaaacaaacaactttatttatataaacctgacgcattgcatgtagatgtccaattgaagcttctaatgttgaaaacaaaacattaattgtaaccaacaacaagggcagcttagtctctggatctttcactaactcctctccaattttatcaacttccatataaacctgagtatgaagtttcaaatttgaaataatatcagaaaattgatgtcatattggcacttaagaaagttaagttgaatagaaagtcttgcatatttataattttctatgtctacaggtgagttcataagtgtacattacatctgttcaccatgaatatttgtctacacttacagaatcatatgatatgccagaagaacttgaaccccacatctacatgtaaataacttagcttaaattctatgctgactgaactatcctgtcaaacctatcctcataatccctctgaaggcccatacaaggaattcccctaaagacatcaataatggtgccacagcaagaaaaaaaaatgggaaagtacacaagagaaaaactaggtcaactgggtgaaaagcagcagctgctaagaaaacatgcaagatacaacaccaccttcataatcatttggtcattccaaattttttctcttctacaaatatgaagattaataacatcaatgtgacggaatcatacaattcaaaggattattaactattgagtaagcttgacaacaacagacaagcaaattatattcattctaattatgaaagactagtcgtgattcaaacacaaggaaaaagccaacttgaacacagcatacctgagccaaaaatgtggcgagtgaatatcttaagctactcaaaaagcctactctctcgccaatataatcagatgcagattggctcagattctgtgtggacgaaccctgagcaatgagtccacacaacaacttaactgtttcatcaataaaagcctttggacccctctcaaatatcatgaaacgtgccttctcggaatccgacctctgaatgataaacaaataagcagtatgactatttcccgaacagacacagtgtgaactacctgtttggataattttttccataaatacttataagagaagaaaataagaagtaaaaacgaaacaagtttctccatgagcaaaaattagcttctgcataagctaatttataaaacttttctcatatattagcttctccaagaagcttatttttaactaacgcataagctcatttccatttttcttcttattttctttcttttcagtgcttatagagaagtttatccaaacaaagtcatatatacagataacaaaagcaaaaacagaaccttagctctggactgccaaaagtgcagattcttttggacgccgtgcaaatttatcaaaacacgctctaatatatcctccacaacataatgcactctagatctcttgatcatgagcctacaagggaacacagcacaaaaaccctaatattcatccatgcgttcgttcaatgtagcaaaagaaacagagcttagaatcataaaatcacaaatgatattcaaacacgaacatttgtttattttatttatcgttgaatttgaggaagtgaaaaaggagaatgaacttacacgggagagtcgagtgaagaggaaggtagtggaagagggagacattcccgacgctgcgttgatctgaagcggagagcgaagttggagaagtagggatagagagcctggattcggttttcgagatagtgagagtaaaactgtgaaaggagtgttctgttctctacggattcggtttccgatggtggaaccgccatgagaaacgctgctccaagcttcgcgctgccaagagtcagagagactttttgaatgccgattgatcgagttctttctaggtttttttatttttattttttaattgttttattttagttcttttattatttttcatgactatgtgaccattagcataataaccataaacatatttaagattaattttcagttttttctttgcaaagaaaaaaaatgttggttattattatttgaatttataatatttagtatttaaaaattaataaaaaattaaaatatgttcagattttttgtctttgattttttttttttgtaattttttagaataattgttagaatatacaccatcaaatacagaatttaggtcaaatacataatttagttcttatgtgccgtaatctcaatttagtctctatataaatttcgtttaataaatcaatctttatattgcaagtattattagtttgctcatctccgtcaaatgtattattaaatttaagaaattaaaaatatatttgaatttaatccatttttatgtataaaaatcacattgaaattccacaattcgtataagactaaattatatatttaattataaagttttcttatactacatataatgaagaattaaactcttttcaaattaaaacctaattatctaattcaagacttatggcatttacatggattgtttgttgtcacataaccaccctcttcgcttaatcccactccaactcctttgccctccctctcatccctccacccccattgttttttctctctcttaagattcgttcgtttgaaaagaaaagaaaaagacagtgaaaaggaaaataaataaacaatgagatgagaaagaaagtgaaaagaaaaagaaataaacaatgagatgggatacacacttatatgttttaattcaaaattttcatcttaatttactttcattttattcttttcactctactaaaggaactcttaaatactaaagacgatttctcacaaattcactatcatatagaataaagatgtcctcagccttatatttccataaagcaacatgacttaaatcatagcatcattgtaggaaaatgaaactagtttggtcgtcaaaagtattaaggcaacatctaaagcatacttagagactagaacttgtaagcatctaaagagctgtgtcattcacctcaccttaaatagtatacatggtgtattgcaatttctttgctccttttcatgttatgcagtgcccgaatcactgattcagtcttcaagggtgaataaactcccatcatcctatgcctactcacgttaatttttacatagttgttagtttgaatttttatgtttgatagtgactcgaataaggaattgtaatttattaaataattatcaattagtaataacttgttcatgttcattataaaagcaacgaaaatttttgctgcgttcatttaaaataatgaatgactatcaattagtaattacttttaagttaattgggatcttaggaatacctgaacccaccgatcaatccaactcaactattatcataatcagttaattcaattcgaatttgtaggatgcacccctatgtttttctcttcactttctagtggacacaagtcactgtgtcacacaattaatagagaaagattatttacacgtaagcggaaaccattgcattctacagcaatattttggggttagtgttataacacaacacggataaaattgctagagcctagagagaatccaatcaagtcccacattccaaattagactaaccattgttggcctttataagtcccacattggttagaatattaggcaaccaagcctttatatatcttctgacaagcacttcagcatgccgagctgcgtagcgtcagcttgtgatccaagtgggggcgtcaaggtggtgggacaaggctctggcttagccaggttgggttggtggctgcattatgctggcctgcccgctccaagttgagagttgagctatgggacttgagcgaaggcacaggtctcctggttcctagacaagggggcaccgcgtgaggctggtttcacagagcagcgatcacccctccctcttgacagtggagggattacaggctgctgctcttccagtccatatagcctgatgagcctagctcttgaaccatcattttttattttttttaccttaccaagttttggtttcacttctttttagcttcctaagtgacatgtgtcttgtctcgtggatcatcgactgaggttgaagtaagagagttgatatccaacatcatcttaaaatcaattcattttgagtttttgacaattcatataacctaaactaaggaaagtatattgatccatgccggttttctacctggaacattgtctgaacttcttcaggttctgacacgttttttaggctttcattgcttaattttagtgtgtttctcaatttgcttcgatacatatcagaatcgtcttcaagcagtttccaggttttcagctagaaattccaaagtatgtgccattgctgattacttatagttcgttcaaatgaaattttcatcaaaccatacagcaagctaggtactttcattcacaagccactaggaacttcaagcactggtgtcaccatttctggttgactaatttgttggttgagacttgagagtacttttagatgaaattgcttgaaaacaagtaattgttgcataacaagttacagggttaaagttgttcatgtataattgcttgtttcctacttacatatatatatgcagcactactacattttctgtcgtacagactcatttggagataaaggctggcttctgagtgtgaatctctattcttatttttttttttccaatataaatatgaaaagaatttaattaatagctattaattaaggttgaactttgaagtcgtggatcatgcacaaaaacataaggagagaattgaattggtcacacgtgacacgtttgcaataataaaaaacaaatgaaaatccgacacgcataggctctattttcacagccacatttaactaatcaaaaaccactcttccacaacgatataaaaaagtcatagaagggaagagataaacataagacagaaagatcaaaagaaaaacagaaataaatggcagcactgggtggctttaccgacatcgctggagcacagaacagcatcgatatcgaaaatctcgctcgctttgctgttgatgaacacaacaaaaaagaggttctttttatttttcttttttcttttcttcatttaagtcaacttttagttacatcttaattaagatattatgatttatgttaatttggtgtactggatcattccatgatcacgtgatttgagaatccaaagtgggtttagtttctttctgtagctctgatacttgacttcctgaatcctgttctgattatgattaggggtgtcacaaataagtaagaattaaacttggtccattataactaactaattagagatttaaatcttaaatggaaaaataatttgtctttggaagggagtatctgacctttgaattattttatctctctcaagagaaactagtcaaatacttataaccatatgtgtataaaaaatgaaatttaattcatttttatatattttgagcagtattttttagttataaattgaaattttatcttactaactcattccattttttaatacaaaactttattatgtgatgtattaaaataaaaattctgattagacaataacatttataaaagcacatatctgagttttatatatttttgtttttatttcagttttctatttcttttttatttcttatgatttaattgaatatgcatggaaacgcagaatgcagttctggagtttgtgagggtgattagtgcaaagaaacaagtggtttctggcaccttgtactatatcactttggaggcaaatgatggtgtgacgaaaaaggtttatgaaactaaggtgttggagaaaccatggttgaactccaaggaggttcaggaattcaagcccatcactgttgctgctaatcctcgttccgtgacggtctagcacatagctaggtatatattttaccatgaaagaaagaaagaaaaaaactggtgatatttaaaggaatcaaataaaaaagaaaagaaaaatgacacttgccgtacaaaacaaacgaaaagttaatgatagaatcatagaatgatagaaagactatgaaaaaataattttgcaaagactatgtgtctctgtttttttttttttttttgaaactaagggactaacaaaaaaaaaattataatgagtatttgatcgacttcacattacaaaaatggatttcttgatttcaaatattatggccttcacgtgcctagatttcttgtctgtttggattattaaatgcgcctttggtgtttttttcaggttaaggaagattatgtaactctagcttgggcgcaagagtgataatatgtatgaactgaataaatgtagctattaactctacaaacggtgtggggttgtgcatgtttgccatcctatttcagtataaagtataaactactacagataaatatttccatcgaaattaataaaataattgattatgtattaatttatgcgtgtttcgtccaatgcgtggatggtgatgattcgaactttatagcagaatgatctggtggtgcggtgccttctgtactcaatgcgattatgaggtcacaatcatgaagtacttgccctccttggatttggacagggtcctaaatatttatcaatttttattagttaaaattaaatgcgttaccatttgtcaataaataaataaaaaggttcaattatttttttcactaatttatttttaactttttatttggttctctaatttttttgaatttaatttgatcttctaatttttaaaattagcttaatttaatcctctaataatttttgggtttaatttggttatctaatttttaaaatcaatttaaattggttacattgtctaaattaatttgaatgatcataccttttaaatgtgtgttttgtggcatttaaaatcatccttaaatatttttaagacaccacaaaagtgtgatttcttaacatgattggctcaatttagaaggcaagatcaaattgtatttcaaaaaaaaataattagagaatcaaatcaaacctaaaaaataaattagacaactaataaattaattttcaaattgcattattatatagacaattgaaacttaaactaatatgttggtatattaagaattatgcatttaacagtacactgattagaggtgtacacgaattaggttggattaggtttgactaaacccgtcacccaacctaatcaaaaaatttgggttagattagattgtgtttgagaaattttttacgaacaaactcgatcatgaatggattgaactagattatgttaattgagtcataatattttaaaataattttattttgtaaaatttaaatttgtatgaattgtgaaaaaattaaaaagaaatttgtttataattatcatctatgactataaatttgaataaatttcctaaacctttaaagcttggctaagatttcataagcctaagcttgacctaccacgggaaaaaaaaaatctcaatttagcaacagaaagttttttactacaacccatcggtcacaaatagcgactgcttctattttcaagcttaaaagaaatattgagatttagcccgtatgttggctgcaaacctatcaaagtctatttcggcagcgaaggaatctgattataataatttgcaaccgaaataatcagtctctgattttgcataattggcgactgaaatgtcggtcgctaacgttgtaaaaatactataaaaacgatgtcacctgtgctattttgtgactgactttaccatccgctaaaaatactattaatttgtgagcgataagctatttcggttggtaatttcattatttatatcaatgtgataaatataaaattaagaattgacaaaaatctaaaatttaaaatatttaattatgtttaaatataaaatatttaaatataattaaaatataaataataataataacaataacataataaatatgtgattattttactttattttttatattgtaattttttacatttttatgtaaaaaaaaataggatagaaaagagacaaaaatataactacgttagattgatatgataggaagagaaaactagagaaaaataggaagtgtgaatatgactacaacataaggatatctaaatattatcactctacctatttatatttaaggtcttttttgaatgtctaatctatcatatataaggattgatataattatataatagaataaggaaaaggtaatgcatgttaattagatgtttgaagtgaataagtatccaaaaatcattataggatactcataaaaggcaaaaagtgaaaaacttcttcaaagcttgtgtggtatgaataataatccgtgagtaaatttcatttttcttttttatttcatggaagcattaaaaattatattatgaggagttctagatacactctctttaatattctctttcggctaatctttttatgattgattgaaattaattaaaaattactaattttaattggtctctcatttaaatcaaaaagagagaatcattaaatgacatgtgaaatccaataaaattaagcattttcaataaattttaatcaattacagaaaaatatctaaaagaaaatgttagaaaaagagtgtcattagcatttttattataagaatcacaatgttagacaggtatcgatcagagtctatatttggttaaataaatttattaattatttactgagtaattttttgttaacttgttatagatatatttatatataagttgcttttaaaatcaaatataaatttaagttagtctatatatatgttttttataagttattataaacaaccgattaaaataagtaaaacataataacttcggacattttctaaaaaaattaagagtatttgtaatttgatttagtttagtttttttttttttacagagatttaatttaacttttagatgaaaatgatgtattagattctatcttaatatttattgacattaattaagtgaaatatattgtaaaattgattggcagatatataagttatatcttaggtcattatcaactcttaaaaatgacatttacattatcataaacaataaaaaattatacgtaataataaatgcattacacacgttttaaaaaatatatattataaaccattcatagttgattagtcataacctttttatttaacacacgcaaaccatctaccatttttttttatgaaacatttaccattcttaaaatcacatactattatgatcaaaaggcgaaagaatatatagttcgttttgtattcatcactacaaatactattatgaacaaaagtgcctatcaaaaaaaatattatgaacaaaagtttaaaatacttctatattatgaatataagcatattaactgtgcagttaggttcaatttcaacaattggatgtaaaaaccaaaccaaagatcaatagaaaatatgtaaattttttttgcagtttattattatttttaatcggtctgatgatttagaattatttagttcaacttaaagacatagataaacccaaataagttctttcaaatgtatcttatttctattcttattgcaaagagaattttcttacccttttcaagtaagcaaaaaaaattataattataagttaacacttcattttttagctagataactttttctttctcatttttatttttaaaaattgattattttaaatataagcaaaccatgacaaatagttccatatatatattttgatagttttattattaaaatttattttaaaaaattcaaataaaataaattatctcaaaatcattttccatataatacatctaattacaaaactaatatcatataatcaattattaaaacaattaatattttttcacagctattctaaatacattttatgatagatccatcaactcattactataagccttgtttatgaatctagtggttgatgattagtctgacacatttttattttttctggtgctactaatgtctaatatacctctttttgatgattatttgtaaagagcatgcatctaatatatctctttttcacatccataataacgtgtatggtcacgaatcaggaacgtgattgtttttttttttttttttgcattcggattgtttggtacgaaagaaacaaatacatgaaatgagaaatacagttgataaaaatggagagaagaaaaatataataaataaaaataggtgaaaacaagtaaaaataaaaacatttaatttaagagaaataaaaataggatacacccggatctttacgaaagaaacaaataaattttaaagagaaatacagttgataaaaattgagaaaagaaaaataggtgaaaactaaataaaaaatataaattttatttaagagaaatacaaattagagagggggagaagttactattcatttctagtcatcgttaatttcatatatatctttttaattctctcttcacctatttctcttttatcaaatataatccatcattaattttttattccatatcatcctcattttcttgtttcttctatctattatatctctgccaaacatatataatgtaccagctttcacagtttcacaactaactcataatggagacataatatgtagttcacacttcacatccaaacacgtgcttaaatcatgggtgagttgtgtccacaagtatccaaaaatgtcaaggttgaagttaatcacttgtctcccgcttattcttctgcagtaattcattgaaacacccacgacaaaacgacgtacggagaatatgaaatttttgttaaaaaaatgcaaatgcaatagttaaaaaaaatgctttttgttaaatattgacaaagggaatatctgagattggtcacacatatgcaaatgcaatagttaaaaaaatgctttttgttaaaataaaaaacataaaaaacgtacatgaataattgttataaataataattaaatatacacactcagtagcggagatcaaggctagcataacagtttttaacatattcatgtcaaaataataattattaattattattattagaatttattaaatgctccaaaatcataaataaattcattaaataagatgtaagatttacaaaattttgaaatttaaaagaatttcaatcaataggaaaaaaatcatatttaaaatgtattactaacatttttcataattattagaattaggtaaaatggaatggactattcttttacaacattggatcgaataatagttcaaattcttattagaataagaatccacgtttaatgcatgacatataattacctcaaaaacagtatttgcataagacaaaataaaaatatttcatctttcattctcttgatctttttttgtttaccactcaaattcaatcagaatgatataagataaactttgatattttccctataaaaagccttagaatagtagtgatgtacaaaagataaagaaaagagaaatggcaacagaaacaaaagagccagtgagtgacaggtggcatcaccgatgtgcctggagctgccaacagcgtcgagatcgacaatctcgctcgttttgctgttgaccaatacaacaataaagaggttctttctttaattttcttcctttaagtttcaactttacaacttaagaattaattaacatcttaatatatgcatgtttaatttaatttatctctatttttatacttgtggtgattatattggagttggaaatgcagaatgcaaatctggagtttgtgagggtgattagtgcaaagcagcaggtggtggaagggttcatatactacatcactttggaagcaaaacatggtgaaacaaaaaatgtgtatgaaacgaaagtgtgggttaggtcatggttgaactccaaggaggtcctcgaattcaagcccatcagtgttaatcctctttcggtgtcggtctagccttaataaggcatacttttaatctctgtcctctcgataaatatttatttgtattagtttctatatttctattttgatcaaattaatctttaaaccttagaaaaataatactggtttcatcattatttttattcttaggaggaacaaattattttctttttttaaaattcgagaattaaattaattaaaacttaaatttgagaactaaaatcaagttttattaaaaaaaatatatggaccgaaaatatattttatcctttaatttactaaactaccatgaccaaatattctgggcgcgcattcatatccacagtgtcgttgtctgttgggattgtttaatatgtcttgtctttcacgttttttttttttttcaggttacagaagattataaatggtcgcaaggtgaaagttaaagtatatatatgtatatgtatgtatattgcattattccttcgaaggtaatgtgagagaataaaaaaactcgaaggtagtattaaatatgttatatgtatttattgtatggaataaatgcagctactatatataatggtacagacggtgtagggcagtacaaatttggcatcctatttcaatatgaacgagtactaataatattacgtattgattattctgtatttacgcgtaaatagctaaatgtttccaattgatgcactaagtgatgcaaaaaaatgttcctttgtttagtttttaaggacaagatgaaaaaaaagtgaaaatacatccacaataaaataaggaagaatattagagtcaaattctcaaactcaaacacactcttttcttcaccagtatctttcatcggttcatctcattttattttttaaaatagttacttgtttaccggttattattcaggttatgacactttataagtttttattttgttttattatttatattttaaagaaccaaaaatcgtctatccctatgcctatcaagtaacttgcccctttattttattcattggcaaagaggttgagtgaggatcaataaggacgaggttaaaaaataagatgagatggaacaatgaaagagagtgggataaaaagagtgtatttgagggtgtgagactctctctacggatatgttattatagttccaagcaaacaaaaatgtaatacatgcttcaacaaataaggttccctcgcgaggacttgcccaaacagtcaaggacctattttttaattaatatccacagaggaatttagatcgaataaagtgataaacacaggaatgcatcatccaatttaataagacatatcactactcatatgttgtaactgtgtcaatagaaattcggctataaaatttcttcacacaggaatgcatcatccaatttatcgctctggcttattcatcaccattgctgatttattccttttcttccatttttcttgtatccgacaacgacacctatgcagaaagcaattttcggcaacccctccctttcctcctttttccctattccacatccacagatggtcactacagtggtggagccacatagaaaacaaggccaggttacaaatattacatatcaacggtacaataattttcttgaaactgcaatttcaaatataatcacaaatcgtcataaaaaatgtcatgattttcaaaaccaaaatcttaggtcttttattcttccaaattggactcaaaattgagagtaaaaatggtatagaaacaacgtttatgcaagaaacaaactcgtaacttggcacccatgagaaaaaatcaacacgtacacaaaaaatatcaaaaagctcaaaactttgggagactaaaatctgggtttgttcaaatgaatccaatttgggtttaagtgaggcaataattatatcaagctttgtgactgtttcgtcttccatgctttttctcttgtttgaaatcttgtggcagaacactgcaagaaaaacgacaaaagaccctctcgagttctctctagtttactccgcacaacggtcaggcaacgacgcatcaacatccctactatcatcggccgtcatggcaccaccgttgccgcttagatgaaggaggaagaatgggaagaagagacgagacgaagaaagaggaagatggtagtacgggaaagaggaggacaaaaaaaggaaaaataataataaaagaagaaaaatttacggtcattgatttttaaataagataatctgatggtgataaaatactttctgactataagagacccattacactctcccattatagcttgcgtcttcctaaatttacggtcattgatttctggttattgtagtgagtttaataaaattcatacatttttcgataataaaatgcatctagtcttgctttgaattcaatggttattggagtagttgactataactagtactagttttagtacccgtgcgcatacgcacgggacggctccgcttcgctccgccgtgttatgctaaatttgtataaaatatttttaatatttaatgattaagaattattgtataagcaaacttaaaaattaaaagtaaaacataaattactaaatatatcatctaataataaattaagcactccactaataacttactctaataaagcaagcatgaaaacatatttttagaagtccagaatgcaaattcttacaaaatatagtggtcaagtgctctaagatgaagtcataattacaagaacaaaacatggttttgaacatagagttaacatttgatagagttaaagataaaagatgtttttaacaaatatatcagtacacatgattgttgctgctgggatcaggaaactcaattacaaactccatatgtggtttgaatttgttgtctcttgcaaatgatttccatccatagctgattttaacatattggcgtgaatggttgaactcaattttgcatgccttggtttcataaaaaataatatttgtgaatgttgttttaattaagaaatcatacatgtctctaggtagatgctgcaaaatcacgtaacggttaactcatgatgacataaaaaataattatttcccataaatgataattgtagtttctatcataaaaatgaaataccaaaaaattatttacattataatatagtgaagaagcagtttaaaactttcttgtaacaaaaattatttttataaattaattttaattgttatctctatcgtatttaaaaataattttatttatgatattattgatgaagttatgtaaattaattgattttgattttcttataacaaagaatcaaataataattttttaataaatatattaactaaatatcattatactggttatcgtaacaattgaattaaataaaaaagagtttaaaaatttcaaataatgattaaatttaaataataaagttataaatttttttattttttaagaatgtcaccatattcattttaaaattatttatcctttttttatatgatgaaaatttaaaaataaataatatatttaataaaacaaatattgttgattatttgatatgtaaatgtgttaaatccttaaaaaaacataagagttcactcatgatagtccaaagaataattgcttcccgtaaatgataattatagtttctatcttaaaaattttaaattaaaactaatttacattatgataaattaagtaagtaatttaaaaaaaaattgtaacaaaaatcatttttaaaaattaatttttatttttatctctatcataactaaaaatatttttatttatgatattattgataaattaatttaataaaaataaataaataatatatttaataaaaataaatattattgattgtttgattataactatgttaaatactttttttaaacaaattttttctctataacggttcacccatgatggtctagagaacaaactttttctatcattaaaaaataaaatgaaaactacattatgatatattaaataagcattttaaaaaaaatttgtaaaaaaataatttttataagttaattataatttttgtctctatcataactaaataaattttgatttatgatattagtgataaaataatttaaattaacaaatattagttgtcctataacaaagaaataaactataattttttaataaatatattaactaaatattattatgctggttatcataacaattaaattaaataaaaaaattaaaaatttcaaattctgattaaatttaaatgatataacatatgcgtctacatatttatgtgtccatatttctattgtttataaattaaagaggaaaaacatagatattcttgtatatttattttattattggaaaatatttcttatatttatttaggaaaacacatttcaagtatctcataataaaaaaaattaaagaaagtagtgggatgtttcttaatttaaagaataaaaataaatgacaatatgtaaataatactgattatttaagaaaaaattaagaaaatagtgaaataatatgaaatcttaaatttaaaaacatattgttatatctaaattacaatacttaacttactatattcatccttaaaaagttttaaaaaaatataatttattcaatataattatgaaaaaaaaaacatctaataatggctgtttaaaaattttggtttgtagttgattaaaattaattaataaaactaaaaatattgtttaaaatttttttctcgtaatggtttattcatgattacctagagaataattatttcccgtaaatgataattatagtttctgtcataaaaaaatgaaattaaaattaatttgcattatatgaataagtaatttaaaactttgttataacaaaaatcatttttacaaattatttttaattgttatctatatgataattaaaaataattttatttatgatattattgataaagtaatttaaattaattaactttatttgtcttataacagagaattaaattattattttctaataaatatattaaataaatattattatgttgattctcgtaacaataaaattcaataaaaagagtttaaaaatttcaaatactgacaaaatttaaataataaaactaataatatttttatttttaaaatgtcaccattttatgttactattatttacccattaatttctatgatgaaaaattaaaaataaataatatatttaataaaaataaatattgttgattgtttgattataactatgttaaatactttttttaaacaaattttttctctgtaacggttcacccatgatggcctagagaacaaactttttctatcattaaaaaataaaatgaaaactacattatgatatattaaataagcattttaaaaaaaatttgtaaaaaaataatttttataagttaattataatttttgtctctatcataactaaataaattttgatttatgatattagtgataaaataatttaaattaacgaatattagttgtcctataacaaagaaataaactataattttttaataaatatattaactaaatattattatgctggttatcataacaattgaattaaataaaaaaattaaaaattttaaattctgattaaatttaaatgatataacatatgtgtctacatatttatgtgtccatatttctattgtttataaattaaagaggaaaaacatagatattcttgtatatttattttattattggaaaatatttcttatatttatttaggaaaacacatttcaagtatctcataataaaaaaaattaaagaaagtagtgggatgtttcttaatttaaagaataaaaataaatgacaatatgtaaataatactgattatttaagaaaaaattaagaaaatagcgaaataatatgaaatcttaaatttaaaaacatattgttatatctaaattacaatacttaacttactatattcatccttaaaaagtttttaaaaaatataatttattcaatataattatgaataaaaaacatctaataatggctgtttaaaaattttggtttgtagttgattaaaattaattaataaaactaaaaatattgttttaaattttttttctcgtaatggtttattcatgattacctagagaataattatttcccataaatgataattatagtttctgtcataaaaaaatgaaattaaaattaatttgcattatatgaataagtaatttaaaactttgttataacaaaaatcatttttacaaattatttttaattgttatctatatgataatgaaaaataattttatttatgatattattgataaagtaatttaaattaattaactttatttgtcttataacagagaattaaattattattttctaataaatatattaaataaatattattatgttgattctcgtaacaataaaattcaataaaaagagtttaaaaatttcaaatactgacaaaatttaaataataaaactaataatatttttatttttaaaatgtcaccattttatgttactattatttacccattagtttctatgatgaaaaattaaaaataaataatatatttaataaaaataaatattgttgattatttaatatgtaattgtattaaatatttttttaaatctttttttccttagtggttaactcatgataaataaaaactaatttacattatatataatgagtaagtaatttaaaattttcttgtaacaattttttttaaaacttaattttaatttttatatttatcataactaaaaatatttttatttatattattgataaaataacttaaattattaactttaatcatattataacaaagaatcaaactataggccttatgcacaaataaggttctcaacttttgaaacaatgaaataatatataaaacttttaaacatcataaaaaaaatggaaagctatagccagttcttcccatgaataaaatacaattaagaaaggataaaaagaagtatcacaagaaaagtactacatcacttccaagagcaatatatacatcactgaattcaaggccaatataaccactacctagaattgctatccaatctggaacaatctccagtttgagtgtatgatcactggtaatcacagtcttccttggatgcacttagttagctttatagtccttttcttaataccttgtcttcctttcgtgctttgcccctctcttttgcagctgctgtcccaaagatgagcttcatatcttctagtccacctatgcttgatacaaaaacaccctttagaaataataaagagaaaaaccattgctcatgcatgaaccatgacatcaagtgaacaaaatcataaacaactcaacatagcatgcttgtacaattattcagccattcataaattgaaagtttaaacattaaaacaaacaaaaaaaggaaatatgatcatttacctcatgagaaagatgttgaacttttggccaccggtggttggaaagatgcaaatctcatgatttttaacaacttgcaaaataaaatccacatacagatttcaattcagtaaacgaaaatgcatacatcaagtagaggggagaaacatagaaaaaatcctacacaagggaaagcaattattgatcatttaggtaaaaaaaaaatcatgtaaaaaatgaagtagttgaggaagcaaaagaaattacaaaactgcatatctaattagggtggggacttcaaaggagaatgcttaagtgcaggaaaaaaaattgaaatcatgcataccagtaacaacataaaggtaagtgtatgttttgaaagtaattatatgcctcaacttcttaaacactcttaattggtgttagattactctttttagaaaatctcttccattcgaatccatataaactccttgtttgtggccatatttgttgtcatcatcccataaaagtgaaaatataaaattactaacaatacgcatcttccattttagactttcaaaaacttgaattgatttgtgggaacctataaaatatttacctctaaaatatcttaggtgaaagttatatgtgcttgtaacaactttaacctcttggtggctgttgcagcttcttcaaatcttctctgaaaaacctgaaagatatatgttcattaatttaatagaaacaaatcatatatcaattacaataaccccaaaaatcaacaacattaatcgtaggttatttgattatttttctttttcctattaagaattttgcatgttgagtggaaacataaagggaagtatccactacatgtcttttttactcatcctctctctcagccatgacttaagatcattacctaaccaaataataaatgaggttttatgtccacataacatatgtgattccaagcaaatactcacgtagcttatcataagtttacattcagaatatcaccaggttgaaacagtttcaatatcagttgtaaagtcatgagtcatgactgatgaatagaaaatgtagccagtgagcataatgctcattgcataatactccctaaccaaatgacaatacataaaacatctgatatatataatgatagctgcagaataaaaaataatataaactgatagcccacaacttaataagctgatatataattatatgttattttacagagaatattaacatttgatagttctagacttaacattttctccaaagaaaacaaagagagagatagagttttaacatacagagagtttatgctagtgagaagaacaaaccaataatattaagcattagtctgtcggaaaactcattttttttaaaaaaatagttaaaataatcaaaacggaaagaaagttgtcagaatgtctaaccgaaactgcactcaatgggtaatgttgccgagccttgatcttgtttgttgtatgggcgaagcaaaaatccttcaatgtgaacaaagaactcaaatgctatccttacgaagcagtaactttaaatctttaggaaaattactatgtgtatagacttataccccaaaaaatacaaaggttgaaagaattctgaatagttagaaagttatataggttaaggagttgaatagagcaggacaggacatgattagagggatgttcatgctatgattcactcagatatataaaactcttctcaagtaaatgtgttttgctacaattgttctcactgtcagttacattgggatgaaaatacacgaacaaaacatgactactacacatgtgtaaaaaagatatgtaactgccagatgcttggaattcatagtgtgtctaaatgctaaaaatgtaaccctctaataattaattgagtaaaatttcattcacttcttagtgtttaaagtgcgaaaatagtgtttacttgatagtgaaaattatatttcactacacaaccaacggcagaaaagtaaataaaaacagaaatttaaatccaagtaagctgaggttagaacataacagtcatgccaaagatgagcaggatgaaaacagagggagacaaatgaggcagtgaggcaggcgttgataatttctcatcaatatctaactatatcatagaatgagtgaaagaagaaaaattgatcaaaggagaaaaaaaataggtacacatctttcccttgctggcttgcccttattacaagatgctaattacattgaaatgttgggtatatttatatttatatgtttatatataattagcatataatctttgatgttgcctattacaattgtgtgcaaattcctaacagagaaaaatgaaagctgttatttagatatgaatgcatcacaaaaaaggaaaattaaaaattacctgtcatcatcatcttcccatagataagtatactcctgctcatagtttacccaacattaggaaaaatagttgattgaaaatcagtaataatcaaagaaaaggaaataaaaaaaaaggatgtagctatagctcttttctgtgtaattagcatccgtcaatcacctctacttttttgttatttccactatataatgattttgaatgtgcttcatcatcatctgtcttccagaaatctgtagtgctgcatccattatcccaggatggcaaacatgcaacactctttaagtggatcagctgcaagtgtcttgggttgattttaataaaaggagcagaaaaagtagagaaaaaatataagaaataaaaagggactataaccaattaacacaaacaataaataatagagaagtaatagaacaaatttgacatacaaattctagactgtaagaacataacttggcatcgtataatttataaactaactgctaggcaagcaaacctttgtaacaccatgaaagccgaatactgccactgcatgtagttctgttcagcaagagataataaaaaagaaaaaaggattaaatattatgggaagacacgtgacacctacaataagtcacaccttatcatattaactattatgggaagtgtgcagatcaaataactaaattctgcaagccatatttttgttttcgtttttcttttttctttggattcaagacaattgataactctattgaatattagcttcatattgcagattacttaaggatattacctcagaaactgatatgaccctaagttttcctggtgctgcatgacctagaaaattattagtctaaaggctactgcaatgcataagaagtgaaatttaagcttgcaaatatattaactaaattactatgatttaaacataacagtaatcatttaagcttgcaaatatataaacttagcaccctattgctctttccttcaacaaagcttgcaaggatcactttgtacatttacatcagaatcaatatattctattttctctaaaattctctaatttctaagaactaaataaggatgacataaagcaactaataacatcatcctcagcttctatgaatataacaaacaggtttaagactaatatgagataaaagattttgagaacatatcccaatcattcaatcaaggctaatatgaggttgaaaacagaaaaacacactgacactggaatccccatttggcatttgttcctgtcctttgttaccaaccttctatgacaaattatgaacttttgctggtcttgatcttttagatgaactcctagaaggagcaacctttgttggaacttcttcgaccaaagcctcaacattcctaataatgtatccttccatgaaacattcctacacccaaatccatccttccatgaaacatataagtgacaacctgcccacatagcattatattacaatttcctacaactcaatatttacagaaattggaaaaaagcaaaacatagatatgttgtggcatagaatttgaaatggctagcatttgtcaattatctatatataccttgggggaacgcctgaattatcagcaataagaggtaagctgaattcatcttatgtagctggactgatacacattttcaagttttgcattgtacccaatgaaaaacttttcgatttaaaattcaactattaaggaagtgccacatgtcattaacttaaaagttccatttactcttcttcaaagttgaattcagatccaagggcaggtgcagtttctccaggccaacctaccatatctgaaaaacaataatcagtttcctagagtcatgaatttttctctggcatcaataaagtgaataagtatattgaacaaagtacatccaattatactttcaacattgaaacagtcaccagtgagtgctgatatattgagatttgacaaagttaaaatacaataacattgataagtatcattttttccagagaatcattatattggagaatttattgttatgtccattcaattcaattccagaaagttaatataatacctgtattgttatttcttcttcgaagctagaggaccataagcaacattctttgctcaattcaatttgatttaaacgattccatatgttgcatttgataatgtgctgattctatgaagattcagtaatatatataccagcatcaatttccatcagttgaattctgtaaatcatacacaagatatatcagcaaaatatgagccaggagtttttgtatttcaacttcttacataatctgattttagtttagtagttattttcaattttagttcttacatatatcatctcttcttgaagtgttaccaactttttctaactgatcatgaatgtcctctgcacagaggttgagtcttgatttggcactttctaaattctgagcacggaatgcctgtttttgaattgcatattgcaaaatactcattatcaagtagtagaaaatcaacaaagtttaacatgcaacttattaaaaacaaatggcattagctgcagcagagcaacaattattaacatcaatgtctcgcctagataaacatattttccaacacatctaatcatgcataccagtacaacactatcaagaattattaacatcattggcaaatacattaaggacaaaagtattagaggatctttatctttctccatttaatcattcatatataaagatttaacattaataagttgatttaacattaatctatgctataaataaatcaaaagcaaagggatgcttctttctatatatgagaaggcaatgaattcttgaaacatgatatgtataatcacttcaccactatcaataattatatccagctgttcattacattgatcaagccatacggcaaataaatgggacaaagcaaaagaaaaaggtaaaaattcaaatctccatattctctaatatccgcattaacaaaatgtaacatgaatacatgatctaaagttgttatgtaagtttattttcatcgagttctaataatttccttaggttctagggtttttagaccagtagcatattgaatgcatacaattttaactgtaacaatatagtttcatttaataagtgttcagttcacagctaaataagagcagaaactaatgttcgagtcatgcatctagctattaacataacaaattactgttaaggaaattatattgaagtttggaaccaagtacacactccattataaatttggcaagaagaaccattatgcagtatttcagctcagaagtaaagattgaaggcaaacctcaggcgccatccagaatgttgtccccttcattgatttaacgtcattcaatttggttgcctgaaaaacaattcataaagcgatatcagaaaattgaaatcataagcaatttaacattattcagacatctataactgatatcaaaatattcaagaaataaaagaaatcctagatcgagaaacataaatgaaagaaagtgaatacctttgccaatccaaaatctgcaagcttgacagatccacttgcatccaccaatatatttgcacatttaatatcccttaaattggagaaatacaattagaatatatttacaatgattgcttcatcccaatgacataactgatacaggaatgcagaaaatagaaagtgaaattaatcacgagctttaacccaaagaaaaaactcttctcatttaaatatccaaagatatgccacagtgaaggagcttttggccatggtctctgaaaatttcaaacagataaacattagaaaacataatagcaaagagaaggaaatggatggaggaagagaaaaagagagacggagcggaagcacaggtcacacaccaaatttcaaaaagctgtgaggcagaggcagaggcagcggtggtgcggtgaggaagaaagtgaaagataagagaaaaaagaaaaatagagaagaaggtggaggaagagaaagaggaaaatggaggagatgaatttggtggagaagagaaagagagagatggactggaagcacaagtcacaaccaaatttcaaatttgaaatttgaaattttgaaagaataaagcagaggaaggaagaagctgtgcacgtgaggtgagtgtgtgagttgaggaaggtgaggaaaggtgagaaaaagagaacggaggaaaggaaagaaagctgagaatgaaggagagcttgccacataggatttggaaggctgtgggagtgacacgtgcacaagccaaaccttcttttattataatatagataaatgcgtcaacggaagttagttaaatatataataaatatataacgaccgctatcatatcattgtacaacgaagacaggtaacattaaattgagagtaattacacgctcccatcctagcccgggtcttcctaaactttataaaaatgtgttggataaataatcatagaattaaatgtgtcaaccaaagttagataaatatataataaatatacaacaaccgctatcatatcattgtacaacgaagaaatataatattaaattgagagtaagttaattaacagtgtcatgatagctgagtctcgctaatccccacaatttaatgaatataattttttttttataatggatatatttttttctgttaacaaatttaatgaatatatttatttactttaaaaaagaattaatattataaatttagaaatcattcaacttaaaaagcttttgaaaaaaactgtaggggttgaggtgttgaacagattgaacattgctgtaatccacaaaataggaaataattattttaagtgtaagttcgaaaactaattaagggctattgttttaccaccatatataatatgttcaagcttcgcaggctggaaagaaagaagcaacacttatagaacagggaatttcagagaggtctccaaatcacttcattttccctagaattaaatcatgaactccaatagcgaagtttcagatgaccacataattcagattaatcaaagtcatgagcaaactccaattgccacttcaacaaactcgccggcaccaaaacatgaaagtagaggagtgaatgaaatgactccagaagagctgagtaagttatacttgaaactattgcattcacaagagggtgcatttcagagatcatgtcttacgagtttgtttattttacattttgaaaaaaattgaatttgaaaccacttgacgttaaaaaaaatatatttatactattattatacgaatgatatttcaacaatgggtttagaaaattattttttattcgaaagataaaaaaagtagaatcacttttaaagtgagtataaataagtcacatgttaagatcaattagcttttgtcaactgaagaaaataaaaaataaattacttctctcaaaaaaaaatttacttatcatcatagaattaattttcaaacttaattaaaggtgattgatgattggatcccttcgactactacataatctcaaatttctcaggtagatttcaatttacaaatgatgaaattattaagaattcaaaatttgagacaagtttccaagagaatttttacagatttagggtaaacgagaaattaaaatggtcttctttgcaactaaatacaaaaagttatgattattatataatggacatgttataatgtgaagtttgaaaggattgcaggttctttaaaaatagatctgacggcacatatatggctggatgagtggctggaatcaaaatcgattattgataaatgtcctgatatggtacgctttccgttaaatgatagtggagacacagctcttcatctagcagtaacggaacacaggggtgaaattgtgaaagagttggttaagcgtatgaggccagaagacatgctaataccaaactcatatggagacacagctcttcatgtagcagtaagtgaaggcagtcttgaaattgtgaatgagttggttaagcgtatgaggccagaagacatggaaataccaaactcaagtggagacacagctcttcatctagcagcaagtgaaggcagtcttgaaattgtgaatgagttggttaagcgtatgaggccagaagacatggtaataccaaactcaagtggagacacagctcttcatctagcagcaagtgaaggcagtcttgaaattgtgaatgagttggttaagcgtatgaggccagaagacatggaaataccaaactcaagtggagacacagctcttcatctagcagcaagtgaaggcagtcttgaaattgtgaatgagttggttaagcgtatgaggccagaagacatgctaatacaaaactcatatggagacacagctcttcatgtagcagtacgttacggtagtcttgaaattgtgaatgagttggttcagcgtatgaggccagaagacatgctaataccaaactcatatggagacacagctcttcatgtagcagcacgtaaatacagctctaaaattgtgaatgagttggttaagcgtatgatgccaaaagacatgctaataccaaactcaagaggagacacagctcttcatctagcagcaagtgaaggcagtcttgaaattgtgaataagttggttaaccgtacgaggccagaagacatgctaataatacgaaactcatatggagacacagctcttcatgtagcagtacgttacggcaggcttgaaattgtgaatgagttggttaagcgtatgaggccagaagacatggaaataccaaactcaagtggagacacagctcttcatctagcagcaagtgaaggcagtcttgaaattgtgaatgagttggttaagcgtatgaggccagaagacatggtaataccaaactcaagtggagacacagctcttcatctagcagcaagtgaaggcagtcttgaaattgtgaatgagttggtaaagcgtatgaggccagaagacatgctaataccaaactcaagtggagacacagctcttcatctagcagcaagtgaaggcagtcttgaaattgtgaatgagttggtaaagcgtatgaggccagaagacatgctaataccaaactcaagtggagacacagctcttcatctagcagcaagtgaaggcagtcttgaaattgtgaatgagttggtaaagcgtatgaggccagaagacatgctaataccaaactcaagtggagacacagctcttcatctagcagcaagtgaaggcagtcttgaaattgtgaatgagttggttaagcgtatgaggccagaagacatgctaataccaaactcatatggagacacagctcttcatgtagcagcacgtaaatacagctctaaaattgtgaatgagttggttaagcgtatgaggccagaagacatgctaataccaaactcagatgggatgcttccagttcacttggctgcagcttcatatggtgacaaccaaagaaaagttaatcgtaagatggtagaaggcaagctagtagcagagactactaaacttcgttgtctcatccacagatcaatagtggacattttgtcctcacagaaagtgcttgacaaaatggatttcaaggatattgaacgactatttttcatgaccattaggttcgacatgtttggtaagtgtaaaactaattaaacaaccttatttctcctttttgtaatctatttctcttttacatattatgaagttttacaaattgaatcgaacccattgaactgatcagataccataagctatatatatatatataatgtttacaattccaacgtcattcgatacaattgaccataattcaataacaaatttaatgaggaatcagttgaaataattaattatgactattaggtttctgaaagactgtgatatcatcctttaaaaccgaacagctcctagctaaattctcattgatttcatatatataaaaggagatatatatgaactcgtacgtggtttttcaatttagttggagtttttatttaccttgccttatactatttaatttgtgcatataacagatttggcattgcgattatttgaaaaacatccaactactctggccattgcaagaaatgaagaggacgttacagcagtgaagatgctggggaaaagactagaggaatgtcaggtaaactttcactagttgaaaatggctttttattttttgtgtgttctatgctaaaatttagatcttatttgacatcatttccattttgattttgatttaagaaagttatatatatttttgctttatataaaaaattaagaattagtccttaattatctatatccagtgtaataatggtatttgatgtttgttgagttattctaataacacaaattaatgtttgccaaggaatcagacggtcggctatatacaaaagtattgactcaagttgaaacatcggaacagaaacgtgaagctgctataaaatcaggaaatgctgacgatgtgaagatgcttattgacaataatcctagattagtgccttatagggaccgcagaaatggatggaacctactgcacttggttgtgctatgtcgacaagaaacaatatttaatattataccattgggattaaaagagcaatcagtacaagcagtggactacggaggtaacaacattctacacttggctgcgcgtcttccacaaggtgaattcgaagaattgtcaagtttaagagcaagcattcaaatgcaaagagatatcacatggttcaaggtcaattaatttgcttagtttttcttattcaacaattctttattcactcgcatgggatcgatcagttctagcaatcttattttaaaaatttaaaattccacaaattttaagattttgttaactagactgattttaaatctttaaaagtaacacgttttaattaaaaatagaaatcattgtatgtagtatttgttgatattgtaacaatttttttttgaaaaattacactaacattctttatatgtttgaaatcattacagtaacatcccctcaaaccttactctaatacctaaggaaattttgtgtaattacactagatcttaggaggtgttgctgtaatttgctcttgttattaagtgatagttgaaagattaattaaatttgggtaccatcatttacatatactcttgatttgaaaatagttcgtggagtcgaatgttcctcgtgaactaagaacaatgagaaacaacgcgggcatgagaccaattgatatattttctgaagaacacaagaagttatccgaagaaattaaggatgcagccaaaggaatagccgaatctggcatgcttgtgtcaacacttgttgctaccgtagcatttgcggctgctctgactgttccaggtcataagaccaatgcctggtttactgtcttcatattgacaaatgcagtcgcattattcacttcttctgcgtctttactctcattcttgtcaaatttcacttcatcaagattcgctcaaagccaatttgtgaaatcactacatcccagcttgactattgggcgttggttacttattatatccgttgctgctatggttgtggctttcactgcagcctcctttttgatatttgatcacacttccaagtgggtttcttatgcagtggcttcaatggggcttttcccaatacttttgtttcttctctttcattttagctttctcgacgaactctggtggtctagattttatcgttttgaaaaactggactaacttattacagagttacagatattggcataacttcaagacactgtattattatttgtttgtggaacaatcaagcttgtgtttaaatttgagattattctacattttctatctcattaaatattacctttattattgttcccgctttaatttgagactatactgcataacgcacgtcaaagcttttccccttccttccatgtggttggtgaagggatcaaatcataacacagaaaaagctttttttattacacattcatctttcactgagacttaatcctattccatttgaaaagaattactatatacaataaaattataataaatataaaattaaaatgaagagaaataaagagaaaaaaaaaatattcttgattgaatgtgttagaaaatgagaaatgaaattatgagtcctaaccaaaccatatttctcactaagagacgtgaaatggagggagaaatggttagcagtattcttttacttatgtttaaattttaaaaaatcaaataattgttttataataaaatatttttatgttgagaaataatgaaataaaaagttcattttcaaattaaatttgattttttatttgtatgaacatttttgcaatgaagatatttttgttttctactctcttatttattcaaacaaataagaatttacatttttttcttgttatttctattcatctaaataatacattattttcatcttattttgtgtatatttcttgagtagagttatgcattaagagtgtaaaaaatttataccaccatccaatcataattcactgtgtataataaatttgttgatttttaaaataataatttatgattaaatcatttgtaaaatcctaaaattgttttatattattagtatatatacattaaatttttatttttatccctcttatttttttccatttatctgatttctcatcaaattcaagataacaaaaaaggttcaagtgcaaatcatgtcgtctgatcagtgagtttgctcctcaaatttgctctcaaattgtactcgagaggacacgttatgtgatacaatagcagacttacatacacaaggccacaatcaaagctaaaataaaatcaaaattcctaagtttaaggatctgaatgtagtgcctactataacctatattaaaatttctcaaataacaataccgtggctatttctaattggtgttggatatggctcatctttcgcagtcagatgacaacccttcttattggcggggtcagcagaaagccaactggggtaagtctactattgtatcataggtactgttgtgggcctctgattatttgtaatatttttcttttattagtagtttgggctagggcccatgaatagctactgttagagtttcttttttatcctatttatattccccttgtaaaccgtgtgacttgtaacgagtgacggtgaggtaattatagtacagacaagatggacgtagcctacattgggtgaaccagggtaaattactgtgtcatatctctctttcctattctcttttctgtttttcgatttgtgtgtgattgtcgatttccaacaattggaacattcaatatctccactttatcctaaaacaaagtttgtaaggactaaagttttcaatgtcctgtccctcctaatcttcctaacgactaaggatttgtctaatactactactctaattctcaattcgaactttataaaccaaaacaggttcatctacatttcttatcataatcctcttcctcttcatcttcatcaatccttccatttaagttaattagctagttgaatgggatcaatcttcattttttccatatcagacaaggaccattcagggtattcctcgtgcttctcttctgacatcgatacccccttcctgctgccactgcaacgtccaggctctgtgtaaatcatgaaaaaaaaatcattattcagataatatttaacatcaagctgctgcgaggttctttagaatgttgcatctctcagctagaatttccacattatgtgctagtgctgattctatagtgcatagtttgctcaattacaaccacagttttcaccaaaagttttaagaaaatcagatagttttggttctttgtataataaggtttacagactattaaatgtacttgaatttgaaggattccatagaatctgagaaaacgtattggacctaatacatatgaatgttataagattattcttgctttgtttttggtaagtcctctcttagcctcctcaatcaactacgaatgataaatgttattcaggtagatgttgacaacttatatattttctagaacaaatattattattatataggagattaagaaacctaaacctaggtttcttgaatctttactatacatttaagtctaataacttttgtataaagaacattttcaactgtattcgcaagtcagtgaagcaacttgtgaatttccctaatgactgaagtaaattcttttgtaaacagcaaaagattcacagtctgcatagacaagagataattactcggcagaaggtttaatcacacaagaaaaatttaagctaactactgagaagtaattgatatattaccttgttatttctcttgggctcctcgtggctgtcattatcatcatctttcctaatataaaataaacaaaattcaccacacagaaaacatgttccaagtaacatgagtattaatcagagcacaaacctcctataaacagtatggtcatcacgagttgcaacagaaccaccaaaatcagaaaccctgctgacaatatcttttagaaaatcaaagacattaaaaatctgcactcactgttttctgcaaaggcaaggatgcaagtaactcagacattttagaaactagaaagtgaaggtaaacgccagaacaaacaacatatgttccaaaagcaagaccatcccaacatttaattttcttctgtagatgtcatttacacgtataatcatgtttgtgcatgtgaaaaatagaaggcaaaagagggaaatttaatgagactgagcacattatcattagaattttcagatccaatcgttctaggctgatatcaaactcagatgggatgcttccagttcgcttggctattttatatggccacaacaaaatggtgcaaattttgtcctctcagaatctgcttcaaaaaatggtttataaggatattcaacgactattttttatgaccattagcagcaacatgtttggtaagtgtaaaactaaacatccttttttttatctagttgaactcgcacgtggtttttcaatttagttggagttttaccttgccttgtacatatgcaatccaccatcgctatttaatttgtgcatgtaacagatgtggcaatgaaattatttgaaaaatatccaactgatttggccattgcaacagatgacgaggcaaaagagacgttaacagcattgcatatgctggtgcgaaagccttcagaaattctaagtaagctttcatgatcggttgagaatggtgttttatttatttatttaattatgtgtcaaaaaaatgatgtttcatataagaccaaactttaatttaacttgtttctttattgtcatgttatacatttgttggaccaatcatctatatatgtatgcttgttgctagacatgaaagaggaccacagcaatgaaggtgctcgagcgggtctggaattgtttaaaaaactatgggctcaagttaaacaattggaatatgaaaagattttagagttgataacttgggcagtgctatttgatgcactaaaatcaggaaatgatgagggtcttagttggattcttgattataatagcgaactagtgacaatgataagggaccccaacaatggacggaacctactgcacttggctgccctatatcgaaatataagcatttttatttagtatacttaggaagatagagcaaatagtaggagcagtggacaataaaggtaacaacgttctacacttagctgctcatctgccacttgaattcaaagcattgtccagttttagagcaaccattcaaatgcaaagagagctcgcatggttcaagctaggtcaattctttttatttttaatatcttgacttaaaaaattaacttgtaatagttattaagtggtaattaaaagattaatcaagttatgcattgacattaattgatcccaaccaatgggcatatatgtatacatatttggataccatcattgacatatactactcttgattgataaatagaaagtagagatggatgtcccttgtgaattaaggacaatgagaaacaacatgggcaagagaccaattgatgtattttatgatgaacagaagaacttatctgaagaaattaaagatgcagccaaaggaatagctgagtctggcatgctcgtggcagcacttgttgctaccgtagcatttgccgttgctctgactgttccaggtgaaaagaccaatgcgtggttcactgtcttcgtattgacaaatgctgtcgcattattcacttcttctgcgtctatactctcattcttgtcaaatttcacttcatctagatttgcagaaagcgagtttaccgcagcctgtgttactttttatctccgttgctgctatggttgtagcttttgctgcagcctcctttctgatatttgatcacacttccaagtgggtttcttatgcagtggcttttcaatggggatttttccaatacttctgtttcttctctttcaatttaactttttccacaaacacttgtgttctagattttatcttccatccgaactctagtaacttattacatatatagttatagacactgctcaaactcaaaaactttctcctcattttctgtatcttgagttatagacagtgtgacagtgtccacactaggttatttgtttgtgaaacaattaagctcgtcttttaatttaagactattgtgcatttcctatcttagtgtttccgacttaatttgagactgtactgccttttccgaaaactgcatatcttacgtcaaagctttgcagcttctttccctgtggttggtgaagggagcaagtatatgtcacaaccactgttattatgttaagaaccatttagatcgacattttaataagaaattatagttattccaaactttgagattgagccccagctattctgtgtttcctaggacttatccatattaaatataaacttcagatatctccaatcagggacggaggcatgtggatctagagctaggatcaagttaactgtactttggaattttagtttcacgtctttcttattagtattccaagtagtttcaaaaccataagaacattctttatgttccaccttagataacgttcacctcatggtaggcaatgcaagtcccggcttttttacgtaaaaggggtaatttttttttttacaaattaccgattgggggtgctttttaaaaaatttacggaaaaggggtaagtcgtagaattttttactacttctaaaaagaaggtcgtaaataattttaggactttacttttttaattttattcccttaaaattgtataatttcttacgacttctaaattgctataatttttaatttacgactttaaagtcgtaaaataaaatcgtggcaaaatatatgactttcatttttttttaaataagtcttaaataataaataaaataattttattaaaattaactaaacaaaataattttaaaaaaattaaacaaaatttaaaaaacctaaaagaaaaacataaattaaaatataaaagtaaaaaaaaaacaaacaaaagtagaagtcgtacaatttcatacgacttctactttaaaaaaataaatagaaagtcgtattatattatacgacttcccaactgaaataaaaaaaatatatatatatatatatataagtgaagtcgtataataatatacgacttatttaaaaaaaaataaaagtcgtaattttgccacgattttattttacgactttaaagtcgcaatttaaaaattatagcaatttagaagtcgtaagaagttatatgattttaagggaataaaattaaaaaagtaaagtcgtaaaattatttacgatcttctttttagaagtcgtaaaaaattttacgacttatcccttttccgtaaattttttaaaaagcacccctaatcggtaatttgtaaaaaaaattacccctttatgtaaaaaagcctgcaagtcccacattgggtagttaattatacaaataattctttataattgtctgacatgtgtactaattagcccaactcccgcttgtaactcaagtgatgttctttgataagtatgcttaaatttatttgttgaaaaaaatatttattttaataaaataaataattttctattttttagtttatttgtctaaattgtgtttatgcttaaaaaacagttttctacttattttgatcaacattatttgtttattaaataagtgcttatttaaaaaatatttattttaaaattacttttttttttttaaatttaaacaaactagtttgaggctagattagttttaaagagcagtgattagtggtgcttatatattaaaaatcaaataagtatattctataataaaaaataataatatcatgatagaaaaataatggaaataattgtaaatgtagtgcctaccataagcaatacctacgtgagattaaaatttctcataagtcataactatactggcaaatggctatttctaattggaacaatttatatctccacttttaacctaaaacaagggttataaggagagtattcaatgccctatccctcgtaatcttcctgaactactaaggagtatctatctaacactgctcctataaaatctactctaattccacataagaacattctaatgacgggcctgtatgagaagtaatgaataaaccaacacatgttcatctacatttcttcatcataatcctcttcatcttcatcaatccttccatttatgttggctagttgaatgggatcaatggtcattttttccatttcagacaaggaccatccagggtattcctcatgcttctcttctgaaactgattttgcagatgaactagtcgggacagaagttggtgtgtctaatgaatccatatcctcatctgggtccaaatttaagtcaaaatttcgaatggacacttcagtagccagcaggtttgcttactggaaaactctgcttaacttcttcaggttccggcagattttccatgctttcattgctttgagtgtggttgtcattctgcttcaatacatcagaatcatcttcccatttggcatgtgaactcatctcttgatctacagttctaattccacggcccctacccctacctctgcccctaccccttcctctgccactgctatgtccaggctctggctgtgcaaatcatgtaagaagaaaaaaaaagttcgataattcagataatatttaatattaaacagctgccagattctttagtgccaattctatagttttcagcacaagttttcagaaaaccagacagttttggtcctttgtgtagtaagcttttaagttgaagtggggcctagcctcgcagactattagacatttagacgtacttgcattcacaagccactagcgggtttccctattgactgaagtaaatttttttgtatccagcaaaaggttcacagtgtgcatggacaagagataattactcagcaaaaggttcaatcacacaagaaaaatttaagctaaccactgatgaagtaattgaatacagtttataaattaccttcttatttctattgagctcctcgtcgctgtcattatcatcatctccggcaactttcctaatataaagtaaacaaagttcagcatacagaaaacttgttccaagtaacaagagtattaaccagagcacaaacctcctcttagtgacagcatggtcatcaccagttgcaacagaacagcctaaatccggaaccttgctgacaatatctttcagaatatcaaagacattaaaagtctgcacacactggtttctgcaaaggcaaggatgcaagtaactcggacattttagaaactggaaagtgaaggtaaacactagaacaaaaaacatgttccaaaagcaagaccatcccaacattttcttctgcagatgtcatttacatgtctaatcatgtttgtgcatgtgataaatagaaggcacaggaaggaaattgtttgattgtgcatattatcattaggattgcggatctgatgttcttataagtacatagtaataaccgacctccaaaagaaagaaacctgcagccttgtaaccaccttgaacagacttgacatagacaaatgaaaagcattcatagtctttgcccccctcctcaaagttatctcatatgttcgatcacacaaatcttgcagaaataactctagtgctttagctgcaatacataaacacaaataatcataaatcagagataattcatagaaactcccaaaagcaggcaaaaaaattacaaatttggagttattttaaaactatttataaatatggagccgtcaaacatatctaaattggacgtgactgaacacccctaatttattgaattaaagatcaactgagtcaccttctaccagtatattgttgtagtttgttgagaatactacaagtgtactggttgtacaattgataaaataaggagaagttattgtatcaataaaaaatttggtttatcaacaatcaacaatacatcaatcaaattattgattactcttttgatttaagagataaacaattaggaatttttggacttttttatatttaattgaaagaaacaagagcacaattgaatactgtactagaaaaatcaattaataaaaatggttaggtgttgaaattcccttgattccaccctaagataatctcttggtcgtcttaattatgtgattcaatttctcttatttagctaaacttcaattcctcggacgataaacccttttttgctgatgataagctctaatccccttatgtcagcaaattaaagaaaggcatggaaaattcacacaagtgcataaaatttatttctatacttgggatttgaatagaactgaactgttttggtattctgaaccaaaacagagagattgcaccaaattgttcctgtgaaccaaactaaaccaaaattagtttaaaagaattagtttcaagttatgctaagccaaaaaagagtttgtgaatagaaagaaactaaaaaatagtctattgaccaattgcaaatcgatccagtagcctactgatcagacattcagacatgtatttgactagttgaatcgccaatctgaagatggtttttgtaatactggttgcaacctcgtgtgcgaatatcttcgtcaaacaaacacaataccttaaatttgatctctcttgttttgttttatcctatcatttaattagtttgcatttatttttctctatattgctactcatgttccactgtaacattcgtagtctatacggagaaaatggaagagcaaacaggcacatacaattagaaaaaaacaggtaatccaattttcaaagatgtagccatgatttgtaaatgaatttaatggttgtgaaaagcttaattttatggatttagccgggcatcataatgtatataaaagtttcaaaataagatcttggatggatatttaatttcagatcttgtaatattaagctgttgattcattcaagaaattgtttttgttcagttctttttctgcttttgtataggtttgcggtttgtcaatgtttgtaattgacacttgtttgttgctgctctccaacaacttcatggtagggcggagaaattggagatttgtaagaaattaagagcactataggcagatggttcaagtttaggcaagaagatgattgaaggagatggaaaactaatcaatgtcgatttggaaatagaagatgaatgtagaatatgcttaaaggcgggcaccaaaatgattttacataattaattatggttagaattgattatacagtaatgtaatttttgtttggataatagttattagaaaaatggtttttttaagaaacggggagcaaaagtctagctaatgggattcatctctcaattctattgacaccccaatctcattagcaccgtaacattcactctaaaatttcattgatgaaaagatgaataaaacagagggtcaaaccatactccatcaacatcagaaaagggatttattatgagagagtgttgtttgaattaaattgattttgatggtgtaatgatcaaaatggatttgaatgtctatatacactgattttctattacaattagttattttgatgtatatatatatatatatatatatatataaaattaaacccaaatctaccaataattaaactgaaatataatatttcctttcataaaatggtttatcacactattatggttatgagtacaaaaataaattagataaaatgcattcaataaaaaaatataacaactagaatctataaattaatatagcaagaattttaatcatgtttttaaatcaataaaaaaacatatagatgcatatgagattattgatttgaaagtaaattagacaaaatctaactagaatttattttggcataagtagaagttattattcctacttcaactccatcataattttttcaattaaatttgattatattaaaataactaaacatgcaaaatctactatatcctatatctactatattatatactacctccatttctatttgtgatgagactcaattatctaattcatcaaaactaaaaaaataattaattaagtcgataataataaatttattctaaaataatatattttcaaaaatactattatcattaatgtttctctctcttctaaatatatatgttaatatgatttctctcttatttaattagggatattttaatagtaaaaaaataatatatacatgagataatatggattataatttaattaacactaatatgttttttaataattatggtaatttttttattatcatggttttattaaattgtcataaatatttattataatgataataaaaataaaaataaatgttatcttaaaaagttataatattgtaagaaattataaattgtaaaattactactgtgcaagtcatgaaccatttaactagttttagataaaatcaagtttgactcatgtcattagctcattcataattttaaagccaaatttcaaacacactataattaatccacattatctttttcgtaaactacacatacaccatatcaaagtcgttttctttccatgtggtttataatttaggatttagggttcttattgtccttgatttaaatcctagatcataaatattatatatatagttatatcttgcatgtgggataatatagtatgaaacacactatcaaatgtcaaacaactaattcaaagcaagatttgaaatatttgagtaaaatatatgtttagactctttaatttagtttaatattatttttagtcttaaatctttcaaaatgtacaatttaatccatagtctgacacagtctagtagtgtgggagagtgtaataggtctccaataaatgataaagtgaatttctaccattagatttatcaaattttaatccgaattttttctttattttttcttttcttcttgactttctcgatttatccctctagcttatttatcaccattgtcgttagccactatgcaccattgccaaaaatcacctctggcggcagcatttcatttttttggcctttcttcttccatttttcttgtctccaacaacgaacctacccagaaagcaatttttggcaaccctctctttcctcctttttccctattccaccatccatagatggtcactacgacggtggaaccacgaccatgcgccaccacgcatcacatatctaaacatagaaaacaaggccagattacaaatattataaatcaatggtataataagttccttgaaactgcaatttcaaatataatcacaaatcgtcataaaaaatgtcatctgattttcaaaaccaaaatcttaggtcttttattctcccgaattggactcaaaattgagagtaaaatggtatagaaacaacgtttatgcaagaaacaaactcgtaacttggcacccttgagaaaaaatcaacacatacacagaaaatacaaaaaagctcaaaactttgggagactaaaatctgggtttgttcaattgaatccaatttgggtttaagtgaggcaatagttatatcaagctttgtgactgtttcgtcttccatgctttttcttctgttgaaatcttgtggcagaaccacggtcaggcaacgatgaatcaacatcaccactatcatcgaccgtcatggcaccatcgttgccgctaagacgaagagaggaagaatggaaaagaagagaaggagagagaggaaaagggtacgggaaataggaggacaaagtaatttgatggtcataaaatactttctcacagtgagagatcgattatcctctcccattatagcctgcttcttcctaaaatttataaaaatgtgttggataagtaattattattattttttttttggatgcatagaacgctcaaaaatttgtttatttattttttaaaagataaaaatttaagttttagtcaataaaaataaaaaatacaataaatttatcaattcattaattttatatcattaataaaataaaatatttaacataaatgaaaaaaatatcataacaacaattaccaacataactattaaatcaaaatgtccgtaactaatataaaaagaccagagttaggatataaaaaaatgaattaatattgaattcaatggttgttggagtgagtttaataaatttatacatattccgataataaaatgcatctagtcttagctttgaattcaatggttgttggagtaattgattataactaagtataaaaagaccagagttaggatataatcatataattaaatgcgtcaacggaagttggataaatatataaccaccgctatggcagaaagttttcgtcaacaatataagagtaggaacttgaaggttttaggtgtgtaaagatatcgtatcattgtacaacgaagataatattaaattgagagtactttaattaacagtgtcatgatagtgagtctcgctaatccacaaatttaatgaatataattcttttataatgaatattttttttatgttaacaaatttaatgaatatatttattcactttgaaaactcaagggttgaaatgttgaacagattgaattaacattgctgtaatccacaaaatgtcatattggacataattattttaagtgcaagttggaaaactaattaagggctcttgttttaccaccatatataatatgttcaagcttcgccggctggaaagaaaagcaacactgatcgaacgaatttcatagaggtatccaattcacttcattttccctagaattgaatcatgaactccaatatcgaagtttcagctgaccacataattcagattaatcaaagtcatgagcaaactccaattgccacttcaacaaactcgccggcaccaaaacatgaaagtagaggagtgaatgaaatgactccagaagagctgagtaagttatactttaaactattgcattcacaagagggtgcatttcagagatcatgtcttaagagtttgtttgttttacattttgaaaaaaaattgaatttgaaaccgcttgacgttaaaaaaataaatatttatactattattataggaatggtatttcaacaatgggtttagaaattattatttttattcgaaagataaaaaaaaaaaaaagtagaatcacttttaaagtatgatgtaaataagtataagtcacatgttaagatcaattagctttagtcaactgaagaaaagaaaaaataaattacttctctcaaaaacaattttacttatcatcatagagttaattttcaaacacaaaattgaaattcaattttcaaacttaattaaaggtgattgatgattggatcccttggactactacataatcttgaatttctcaactagatttcaatttacaaatgatgaaattattaggaattcaaaatttgagacaagtttccaagagaatttttacagatttagggtaaacgagaaattaaaagggtcttctttgcaactaaatagtaaaagttatgattattatataaaggacatgttataatgtgaagtttgaaaggattacaggttctttaaaagtagatctgtgggaacaaataatgcgggagaaatggcccgaatcaaaattgattattgataaatgtgctgatatggtacgcattccgttaaatgattttggagacacagctcttcatgtagcagtacgttacgacagcctggaaactgtgaataagttggttaagcgtatggggccaaaagacatggtaataccaaactcaagtggagacacagctcttcatgtagcagtacgttacagcagccttgaaattgtggatgagttggttaagcgtatggggccaaaagacatggtaataccaaactcaagtggagatacagctcttcatgtagcagtacgatacggtagccttgaaattgtgtatacgttggttatcgggatggggccaaaagacatggcaataccaaactcaagtggagacacagctcttcatgtagcagtacgttacggcagccttgaaattgtggatgagttggttgagcgtatggggccaaaagacatggtaataccaaactcaagtggagatacagctcttcatgtagcagtacgatacggcagccttgaaattgtgtatacgttggttatcgggatggggccaaaagacatggcaataccaaactcaagtggagacacagctcttcatgtagcagtacgttacggcagccttgaaattgtggatgagttggttaagcgtatcgggccaaaagacatggtaataccaaactcaaatggagacatagctcttcatgtagcagtacgttatggcagccctgaaattgtgtatacgttggttatctggatggggtcaaaagacatggtaataccaaactcaagtggagacacagctttttatgtagcagtacgttatggcagccttgaaattgtgtatgagttggttaagcgtatgaggccaagagacatgctaatacgaaactcagatgggatgcttccagttcacttggctgctttatatggtcgtcccaaaggaatggtgtacattttgtcctctgaggaagtgcttgacataatgtatttcaaggatattgaacgactgtttatgatgaccattaggttcgacatgtttggtaagtgtaaaactaattaaacaaccttatttctcctttttgtaatctagttctcttttacatattatattatgatgttttacaaactgaatcgaacccattgaaccgaacagattccataagctatatatataatgtttacaattctaacgtcattcaatacaatggaccataattcaataacaaatttaatgagaatcagttgaaataattaattatgactattaggtttctgaaagactgtgatatatatcatgcatcctttaaatccaaacaggtcctagctaaaaattctcattgatttcatatatataaaaggagatatatatgaactcgtacgtggtttttcaatttagttggactattttatttgtgcatataacagatttggcaatgcgattatctgaaaaatatccaactactatggccattgcaagaaatgaagagaaccttacagcattgcatatgttggcgcaaaaggctccaaaaattttaggtaagctttcacaagttgaaaatggctttttatttttgtgtgtgcgctaagctaaaatttaggtcttatttgacatcatttccattttgattcttattttagaaagttatatatatttttgaattatattagtccttaattatcaatgtaataatggtattagatgtttgttgagttattctaataacacaaattaatgtttgccaacacatgagtcacatgtgaaaaaatattttacaattttttttcatgtatggggattaaaatatataattttttaaatagagataaaaaatggtgcttcatatacataagaataaaattttaattgaagttttgtttgtttcatttcatgttaaacattggttggaccaatcaactatatatatacctcttgctagtcatggaggactactacaaggaatcagacgctggtccgctatttgaaaaattattgactcaagttaaccaattgaaatgtaattcgattctaatggaattgatatcatatgatacgcactactacaaatggccctttcgacgacgcacaaaagaagacggttatgcgaaaaccgtcttcttatggtaggcggtggcattacttgtaaatatactcttattttcaaggacggttctaacattaaccgtcttctaaagctgcgtgttaaaaaaccggtggcatttttgtaaatatgttgaaattatagtagacggttttcgaaaaccgtcttccttttggccatttaaactgattttcttatcgcccgtgccctagccttttcgaaaaccatcaacctcagtctcctcaaacatcctcactctccaatctgtgaaatcaacctcgcattctcctctaacagtatcccatgccctagccttttgccctagcctcactcgccttttgccctggcctttttatctgatttggaaattaatcccgtgccctagaaccattcccaatttgttcttcatttcgttctctcctctgttttcgaagcttggcatcaacagcaccagaactaggtttcgtgcgttttgccctctcactgtcgttcatatgtttatctcctggttacttttcaatttctctactttggagtgtttatttatttttgctccgctatggatttaacttgatgcaactgtaggtgcactctgttgttggaaatgtggcattcctccaaattaggaaccctcactgctgtaggtgcactttgttgacggctgtgagtatccctttccctctcttatgtatttcatccatggtgtcatgaattgaatttgtgggttttgttttctccatgattctgtgagtgactgagttcccatccaaaacattttgcttatgggattttctgaggtttgttaggtatttggagcataaatgtgtttgatgtaccagtagtggtgttactcaaaattttccttccttattggactgctcttaacaaccaggtctctctctatctttatctttctacattttctctttactctttttttttatatgattcatctcagttctggattcgtgttctgtttgttcttatgaaactgaagttggaaaattgggtctgtgtgttggcactttgttgttccaagttcaaatttttatggcttgttttatgttgattactgaacaatttgtgcaaatccaatttttcttgatctcttaattggtggcttttctgaaccagtcttattaattagtttaaacttcaaacataatttttagcctggccatttttcttgatattcagttcgaagataattaaatttgttggttttcttgtctgcagatttcacatcaccctccagtaactgctctccatgcaacagatgagaaggaaaatattgaaatgttatggtgccagcgacctgatccaaagtttaatggtatctcacttcttgacctttttctaggatcttaattaattcaaatagactattatacatctcaatattatgtttgccaccctgcaattctgttaaatttcattcctatccttgttattccattgagtcataggaatgaatggccttgttaacattgtgtgtttaacttgagcataatttgttatccctgcaattctgttaaatttcatctcaaagtttaaatgtttaatgcataatttgttttctaattttttaaggtatataataataaatttatttgaatgtttaacttgagcaaaactaaaataaaatctttttattgtaaatgattggtgtaattaaaaaatttgtaccaatcatcttaaggtaaaaaaaattacatcaatcatttaccgtcaaattatttaatccatttttatttaagatttttttatctattaagatttatcacaacatcgtcttcttttaatccaagcttgtaggctaattatagctaataattaatgttaatcaagcttgtggttaaacctgctttctaccattaaaaaatgtgtaggaccaattcagacaggtatgaggcaagggttagtcaacagaacaggttttggctaatcactcttctttctattctctgtttatgcttgcagtttttatgttggagccagacttgttgagagtggcaaaacaactatagtcataaccttcattgtttgctatgctctcgcatctttcatttctggttatgttggtgtttttcctagataattttgagagctgagttcatcacactattctagcattgaacaattcatttaaaatacttttcaggtatttttttgctctctctatggcagctatagcaatgtcacaatctggcttcatgacccctgctgcaagtactacaaaaagttctgctgcttctgtatttgctattcttgatcataaatcaagaatagacccacgtgaatacaggtcagtatgcatggctgtcttcttgctgcttgatctaaaagcttaagttataatccaatggcctgagaaacatttttattgttagtacaacttcagattaatgttgtagtaactataagttataatcagtctgttgaactaatctacatgacaccattgaggaaaatattggctctgagcattgtttttgtgttattcctgcctgatcggtataccatgcagggatagagtagagtagtcctttattttattttttttatgtgaaacatgtgtattggacaattattctattataattcccattatagacattttattctagcaaaccagtgtgaccttgtttctattttgttgcatatggcattcaacttgcatatatttcatctagtacttgtggatatatgaatgtgctgcatgaatttctgttgaaatgataattctccctctctgttcctacccttccattgtgttcttattacatgggttgtgtgtttataggcaaatatgatccatgaaagcacataacagcaacccaagctttggagcacaagtaagactccttgtattctcttttgttcttgcatgaaatctgcataggaaggagcatagtctctgaagttggaacttgaggcagccttgaagaattctcttaaagaacaaaactaagaaaatgatatacttaggtactatctttgttgaccttaatgattattaagggtaatttctagttagacactaatatttgttaaattttatatataattatcggattggcttttcaaacttttcttggatattctggacttatgtcactgttagtaaggtaagattgtgggtttttttatacccgttaatttgtcttgtttttttagtacaaacttcactgtttcatcacacaacatttattcttgtgcattgattgaggcaatttataaatgtggtgcattgattcgttcaatatattctcctcattcatattgcagtggctttcttagtatctatccaaatctttactaattttcttactaattttctgtcatctatcccatgacaatctgttgctcaaagtttcttatatttgacatctgatatttgttcataatgataggttttctcttctcctattttctaatgattgattttctttgcccaaatgcacttgtactaccatttacttgagcgtgctacactaggttattgattacttataaactccattctttgtaaactagttccgagcataggttattgatgacttcataatgaaattgtcttgatttggcctggaattttctattatgttatagaatcctagttttgctgaaaagcacttttaaattcaatgaaaccattcacttgcagtcttttgcttaggtttagatatccatttcctcatctttcctttgtctctcctgccttcttgtttgtctgtttgggtgctaaaattcatgtatctgaatacaagacaatagagcaacttggttatgttgttgaatgtagcccacgagtaacataccgtgtctttgggttttgtttgtgtgtccagtcatctgagtacaacctagtttacttgcaaggtagaattgaaaacttcttaaatggcctggaagaattgttggtaagtgttcctcattctttcaatctccatgttcttagcctatttgcttccttgtgaactgcaattaagttaacatgacttgggttcttatttcttaagaggttataaacccaccctgctatttatgagagaggaggaaatggatgcaaatagtaaaatgcgagcaatttgtaatcaggagagtctgaaagctattctccctctcagatgacggcattaacattgttatagcccaaatctaaatagtttatcatttagatcacagacaatgggaaatccattgcctgttttaatgcttgttatgtagttgtctcaaattcaatgaaaaacaagaggttgggaaaaagagacagacaacacgaaagctgttattctatgaattatttttcatttctctttgtagcaaaattatctttctttgttgagttttcattgcaaagacaataagatgtcaaaagaacttgttccaaaaaggcttttttgtttctaactagattttttgattcccttgtctaaaatattatattgaaatgtatatacatttgctgaatgaagacttatgctttggacaaatattttgggattgcaggatggacttgatggtgattcctttgagaattacaaaagtgggttaatggcaaagctgctggagaaagacctttcactcacatgtgaaagcgatagattttggaaccaaattgttgaaaaaaggtattttatattttggggtctaaatggtagtggtagactatagttatttaagttgtcaattaatgttgaagtatcataaccagcagccacgtattcctacatggttcagctgccagatatctcatgttcacattttgttatttctggttactgctgaatctgacctgtttatggaccaatttctgccaagtgacactactacaaatttctatctaggtattaaatttctatgtcactaagtaaagttggttaccaaaataaatgtcctagagcaacagaaattaagctatttacttatggaggtcatgacatggtttgcctacttatattaacttttgtctcttccaacaccaatatttttcagattgtttaaggccaaacacagcattgttctggatatcatgaatatatcatattagatgatcaagattactatgcacagagtcagtcctaaaccctcctttaataatccgtctagctattatgatctatgttttttattacaacaagttttagtccatcataaacttttgtacactaaaagcattcttaatcaatcaattgcatttaaatgttaaaatttaaatatatatatatatatatatatatatatatatctcttttggggtctaaatgtctcatatttgtatgtttggttttttgttttttgtttttttttttaaaaaggatacaaagacggttttaggcaaaactgtctttgtatgtggacatacaaagacggttttgcctaaaaccgtctttgtatgttttgttttttgtttttttttttattttttaaaaaaaggatacaaagacggttttaggcaaaattgtctttgtatgtccacatacaaagacggttttgcttaaaaccgtctttgtatgttttgttttgtttttaatttttttattttttaagaaaagatacaaagacgattttaggtaaaactgtctttgtatgtgaacatacaaagacggtttttcctaaaaccgtctttgtatgttttgttttttgttttttttttttaaaaaggatacaaagacggttttaggcaaaactgtctttgtatctaattttttttaaaaaaataaataaaaatacaagaaacaaagacggtttttgaaataaccgtctttgtaacaccccatacaaagacggtttttgaaataaccgtctttgtttgtcctcgtaaaaaaaaaattgggatacgaagacggtttttagaaccgtcgtcgaaaggtccaacctacaacgacacgcgcataaatgacggttctagaaccgtcgtcgtatgtgttctagaaccgtcgtcgtttgttccgtgtgtagtagtgacggggccagtgctgtttcatgcaataaaatcaggaaatgttgaagttgtgaagacacttattgacatggatcgtatatcattagagatgtataatgaccctgaaaatagacggaacatgctgcacttggttgtggtatttcgacaaaaaataatatttaatagtataccatggggattaaaagagcatctagtacgagcagtggacaatgaaggtaacaacattctacacttggctgcgcatcttccaccagttgaattcgaagatttgtccagtttaagagcaagcattcaaatgcaaagagaggtcgcatggttcaaggtaaatgaatttgcttagtttttcttattcaaccattctttattcactcgcatgggagcgatcagttctagcaatcttattttaaaaattaaaaattccacaaattttaggcttttgttaactaggctgattttaaatctttaaaagtaacaagttttaattataaatagaaatcattgtatgtagtatttgtttattattgtaacatttttttaaaatttgttatccattgtctttatcataatagttaaacaggctatatatagatatacagaaaattttaactaaaaattatacaagtgcatttgtaacaacaaatatcacccgtaagatttatttttaaaatatcttaactttgaaattgtatttcttacaaatttaatatctaatagttattagagtaaattacaataattctcttcagtttcgtctcgtgtaattatatgtaattccattttttattttcctactttaactttttttaagtttgaaaaattatactaaaattttctatatgtttaaaaatattacacgaatatttcttcaaactttacgttaatatctcggaaaatatgtgtaattacattaaaactcgggagatgttattgtaatttgctttagttattaagtgataattgaaagattaattaagttatgcatttggataccatcatttacatatactcttgatttgtaagtagttcgtggagaggaatgttcctcgtgaactaagaacaatgagaaacaacatgggcaagagaccaattgatgtatttaatgatgaacacaaggagttatcccaagaaattaaggaaacagccaaaggaatagccgaatcaggcatgcttgtgtcaacacttgttgctaccgtagcatttgcggctgcactgactcttccaggtgataagaccaatgcctggtttactgtcttcatattgacaaatgcagtcgcattattcgcttcttctgcgtctttactctcattcttgtcaaatttcacttcatcaagattcgcacaaagcggctttgtgaaatcactacatcccagtttgacttttgggcgtgtgttacttattatctccgttgctgctatggttgtggctttcactgcagcctcctttttgatatttgatcacacttccaagtgggtttcttatgcagtggcttcaatggggcttttcccaatacttctgtttcttctctttcaatttaactttttcgacaaacatttgtggtctagatattatcgtttgtcctgactggactagcttattacagagttacagacattttggcataactttaagacactgtattattatttgtttgtggaacaattaagcttgtgtttaaatttgagattattctacattttctatgtcatgaaatattacctttctattgttcccgccttaatttgagactacactgcataacccacgtcaaagcttttccccttccttccatatggttggtgaagggagcaaatcataacacagaaaaagcttttttttattacacattcatctttcactgagacttaatcttactcgatctaacaagaattactatatacaacaaaattttaataaatataaaattaaaatgaagataaataaagtaatacaaaaatattcttgattgaatgtgttataaaatgagaaatgaaataatgattaatgagtcataaccaaaccatatttctcactaagagacgtgaaatggaagaagaaatggttagcaatgtttcttttacttatgtttaaattttaaaaaatcaaataattgttttataacaaaatatttttatgttaagaaataatgaaataaaaagttcagatttttcaaattaaatttgattttttatttgtatgaacatttttgcaatgatcatatttttgttttctactgtcttatttattcaaacaaattaaaacttatattttttcgttttatatctattcatctaaataataccaaactttacaaaatatctttaaccttatagaaagcatttaaaaaaatgataaacgaaaaaaaatacatacgaagacagtttttggtcaaaatcgtcttcgtatgtattttctttttttaaaaaaagggatcaacaaagatggcttgtacatacaaagacgatttttaataaaaatcgtcttcgtaggtgtataaaaaaatcgagaaacaaagacgtttttttatccaaaatcgtctttgtatgtatataaaaatcatttttgtatgtgtacatatacaaagacggttttggataaaaatcgtcttcgtaggtgtgtaaaaacaaacaggagaaacaaagacgatttttatccaaaatcatctttgtatgtgtacagacgaagacggtaagtgtgtaaaaaaaataggttaacaaatacggtttttacaaccgtcgtcgaaagtcatcattttcgatgatacgcgcaacaaagacggttctacaaccatcgtcgtaaggggttgagaaccgtcgttgtttacctccgttgtagtagtgaatgtttacaattccaacatcatttgatacaattaaccataattcaataacaaatttaatgagaatcagttgaaataataaattatgactattaggtttctgaaagactgtgatatataccatgcatcctttaaaaccaaacaggtgctaactatattctcattgatttcatatatatatatatatatatatatatataaaggagatatatatgaactcgtacgtggtttttcaatttagttggagttttaaatttttaattaccttgccttgtgctatttaatttgtgcatataacagatttggcaatgcgattatttgaaaaaacatccaactactctggccattgcaagaaatgaagataaccttacagcattgcatatgctggtgcaaaagcctccagaaattttaggtaagctttcacaagttgaaaatggctttttttgtgtgtgctcgtgtgtgcttgcgctaagctaaaatttagatcttatttgacatcattttcattttgattagaaagttatatatatatatatatatatatatatgtgtataaaaaaattaagaattagtccttaattatcaatatccagtgtaataatggtattagatgtttgttgagttattctaataacacaaattaatgtttgccaatacatgagtcacatgtgcaaaaatatcttacaatttttttcatgtacggattaaaatagataattttttaaatagctagagataaaaaatggtgcttcatatatataagaataaaaatttaataagttatgtttgtttcatttcatgttaaacattggttggaccaatcaactatatatatacctcttgcccgacattgatgaggacgacaagaaatcagacgctggtcagctatttgaaaaattattcactcaagttaaccaatagtcttttgtttcttatcaacatatcttttaggatatttttgacagtctcttacatgctttatcaaattagtgattccatatttagaactattagtcttatatgatttgcgacaatacttgcaaaaagcatcatcatttaccctatcaaaatgaacccaaaacactaggagttttggtagattttctttttagcacttttgcttgtgaagataagtttctcgcccttgttgtgtaggaacctttggcacttattctaatagtgatggagcttcagtgggtgtaggtttagtaggacattgagaaggagtaagcgatggcggaggacttaagaccttaacactttcagtacaatttctatttgtcatttgtctaatacaacctatgcaatataaaagaaaaatatcaacaacataatatactcaattttggtaagtctctcaattaaattaagaaagataatcattaaacaatatgtgaaacccaccaaaattaaaaattttcaataaattttaatcaattacagaaaaaatatctaaaagaaaaagtgtcatagcatttttcattattaggaattacaatgttagacgggtattatagtctatatttggttaaatagcttgattatttatgtactgagtaagattttgttaatttgttatagatatatttatatataagttgctctttaaataaaatataaatttaagtgagtctatttatatgttttttataagttattataaacaacctattggaataactgaaacataactttggacatatataagttttctaaaatatttaggagtatttgtgatttgatttagtttattttttttttacaaagatttaatttagcttttagatgaaaatgacgtgttagattctatcttaatatttattgacattaagtgaaatatatattgtaaagttgcttggcagatatataattatatcttaggaattgaggttggtatcatatgatagatttcaattaaaagttattattagtattaagtaaagttgcacaatatatatatatatatatatatatatatatatatatatgttgtacatcaaaaattgtagtagataatgtaaaatctttcaacattttgtaattaaaaaaaaaacaatttatgtttatatatatgacttttaattgtttttaatttaataacagacaaaataaagcgcatcatctaacaaccaatcaggtcattgtcaaagcttgaaaatgacatttacattatcataaacaataaaaaattatacgtaacaataaatgcattacaaacgttttaaacaaatatatattataaaccattcatagttgattagtcataaactttttatttaacacaagcaaaacatctaccatttttttaagatgaaacatctaccattcttaaaatcacatactattatgatcaaaaggcgaaagaacacatactatttatgaacaaaagtgcctataaaaaaaatatattatgaactaattaaataattatttagtttaagttaaagtcatagataaattcaaataagtctttaaaatgcatcttatttttatttttcttgcaaagagaattttcttacccttttcaagtaagcaacaaaaattaattttataattataagttaacacttcatttcttagataacttttgctttctcattttgtttataacaattgattattttaaatagaaaaaaccattacaaatagtttcatatatttttatagttttattattaaaatttattttaaaaattcaaataatataaattatctcaaaatcattttccatataatacatctaatcacaaaactaatttcatataatcaattattaaaacaatattttttaccacaactattctaaatacgttttatgattgatccatcaactcattactataagccttgtttctgaatctagtggttgatgattattctgacgcatttttattttctctggtgctactaatgtttaatatatatacctctttttgacattatctattttatgttgatcatgattatttgtaaagagcatgcatctaatatatctctttttcacatccataaaacgtgcaagctcatgaatccgcaacgtggtacgaaagaaacaaatatattttaaagagaaatacagttgttaaaaattgagaaaagaaaataggtgaaaactaagtaaaaagaaaaatatttaatttaagagaaataaaaattagagaggagagatctttgatttcgtttttttaattatctcttcacttatttttcttttatcaaatatactccatcattaattttttattccatatcatcctcattttcttgtttcttctgtctattatatctctgccaaacatagtgtaccagctttcacagtttcacaaccaactcataatggagacataatatcgtagttcacacttcacatccaaacacgtgcttaatttgttatagatatatttatatataagtttcttttaaaatcaaatataaatttaagttagtctatttatatgtttgttttataagttcttataaaaaaactattgaaataagtaaaacataactttggacaaacataagttttctaaaaaatttaggagtatttgtaatttgatttagtttagtttttttacagagatttaatttagcttttagatgaaaatgatgcgttagattctatcttaatatttattgacattaagtgaaatatattgtaaagttgctactagtgacggaaccatgaaataattttagcgtatgccaattatcaattttttaagtgtattaataaaataattatatataataaaaataattataagtgtattaataattttagtccatatcatgattattgttggtttaggaatgactccgctggttgctaagcatatatataagttatatcttaggaattgaggttggtatcatgcatatgttagatttaatttaaaagtaattagtattaagtaaagttgcgcaatatatattgtgtaccccaaaaattaattgtagtagacaatgtaaaatctttcaacattttgtaatttaaaaaaaaaatatttttatatgacttttaattatttttgatttaacaattaacaaaataaagcatcatctaacaaccaattaggtcaatgtcaactcttaaaaatgacatttacgttatcataataataaatgcattgcaaaagttttaaacaatatatattataattaaatcattcatagttgattagtcataaactttttatttaacacacgcataacatctaccattttttttttatagataaaacatctaccattcttaaaatcacatactattatgatcaaaaggcgaaagaatatatagttcgttttgtattcactacacatactattatgaacaaaagtgcctataaaaaaatattatatatgaacaaaagtttaaaatacttctatattatgaatataagcataataactgtgcagttaggttcaatttcaacaattagatgtaaaaaccaaaccaaagataatcaatagaaaatatgtaatttgtttttgcagtttattattattttaatcggtatgatgatttagaattatttagtttaacttaaagacatagataaacccaaataagttctttcaaatgtatcttattttttttttattgcaaggagaattttcttaccctattcaagtaagcaacaaaaattaaatttataattataagttaacacttcatttttttagataacttttgctttctcattttatttttaacaattgattattttaaatagaaacaaaccattacaaatagtttcatatatttttatagttttattattaaaatttattttaaaaaattcaaataaaataaattatctcaaaatcattttccatataataaatctaatcacaaaactaatttcatataataaattattaaaataatattttttccacaactattctaaatacattttatgatggatccatcaactcattactataagccttgtttctgaatctagtggttgatgattattctgacgcctttttattttttctggtgctactaatgtataatatacctctttttgacattatctattttatgttgatcatgattatttgtaaagagcatgcatctaatatatctatttttgacatccacaaaacgtgtatgttcacgaatcagcaacgtgatttttttttttttttttggcactcggattgtttggtacgtacgaaacaaatacatgaaatgagaaatacagttgataaaattggagaaaagaaaaatgtaataaataaaaataggtgaaaactaagtaaaaataaaaaatatttaatttaagagaaataaaaataggatgcacccggatcgttacggaagaaacaaataaattttaaagagaaatacaaattagagagggggagaagttactattcatttctagtcatctttgatttttttttttttaaattatctcttcacctatttctcttttatcaaatatactccatcattttttattccacatcatcctcattttcttgtttcttctactattatatctctgccaaacatagtgtaccagctttcccagtttcacacccaactcataatggagacataatatcgtagttcacacttcacatccaaacacgtgcttaaatcatgggtgagttgtgtccacaaataaccaaaaatatcaaagttgaagttaattagttatctacagcttattcttctacagtaattcatggaaacacccacgagaatacttacggagaatgagatttttttattaatagaaatcaaaacagtattaataaatttataataattcatatatgttatcaatcaattaaactagacatattgacaaagggaatatctgagattggtcacacatttgcaaatgcaatagttaaaaaatgttttttgtttaaaataaaaaacataaaaaagtacatgaagaattgttataaatagtaattaaatatacactcagtagcggagatcaaggctagcataacagtttttaacatattcatgtcaaaataataataataataattattattattagaatttattaaatgctccaaatcataaataaattcattaaataagatgtaagataaaaaaactttcatctttcattctctggatctttttttgtttaccactcaaagtcaatcagaatgagataagataaactttgatattttgcctataaaaagccttagaatagagtacagtcatggtgtacagaagataaagaaaagagaaatggcaacagaaacaaaacagccagcattaggtgacatcaccgatgtgcctggagcttccaacagcctcgagatcgtcgatctcgctcgctttgctgtagaggaacaaaacaaaagagaggttctttctatatttttgttttctttcttttcttcatttaagtcaacttcacaacttaagaattaggattatctttttattttattttagaagttataagattaacttagtaattattaaaaaaaaaaagagattctgaatttgaatctaacaaaaactaataaaactcgttgaagttcacgttattctgcacatgaatctctacaaggggatcacataggttatgctacatttcggttgctttgatgacaaaaatgtttaataaccaatgtcagcaggtagggatggcgctgcatctgcatggagttcttttgtttctattgttgtactgtttctttcgtttggtatcattgatacctatcacttattaatatatatatcttactaacttatgctaatttttaacacaaacttttattaagtgggatattaaaataccatttctgattagagaacattaaaaatacttaataacaaaattatttctcagttttatctagttttaaatgcatttctccttttattattattattattattattatttgtgatgatttaattaattggagatggaaacgcatgcatgcagaattcagttctggagttagtgagggtgattagtgcaaagcagcaagtggtttctggaatgaattactacataacattggaggcaaaagatggtgagattaaaaaggagtatgaagcgaaggtttgggtgaggaattggttgaactccaaagagttgctagaattcaatcctaaaccaatatttggtgcctttacccatattgtgcctcctcatagcgacgaggtcgacaatctcgctcgttttgctgttgaccaacacaacaaagaaaaggttctttcttttcttcctttaagtttcaactttacaacttaagaattaattaacatcttaatatgcatgtttaatttagtttatttctatttttaattgcatgccattagttttctcttcttcttcttttttttttttttacttgtgctgattatattggagttggaaatgcagaatgcaaatctggagtttgtgaaggtgattagtgcaaagcagcaggtggtggaagggttcatattctacatcgctttggaagcaaaaaattgtgaaaccaaaaatgtgtatgaaacgaaggtgttggtgaggccattgttgaaccccaaggacgtcctcgaattcaagcccatcagtgttaatcctctttcggtgtcggtctagccttaataaggcatatttttaatctctgagctctcgataaatattaattagtattagtttccatatttttattttgatcaaattaatctttaaaccttagaaaaataatactggtttcatcattatttttattctgaggaggaacaaattattgctttttttttaattcaagaattaaattaattaagactaaaatttgagaactaatatcaagttttattaaaaaatatatggaccgaaaagataatttatccctttactaaactaccatgaccaaatattttgggcattcatatccatggtgtcgttatctgttgggattattaaatgtgtcttgtctttcatgtttttttcaggttacagaagattataaatgtggtggcaaggtgaaagttttagtatatatatcaagactatatatatatatatatatgtatgtatgtatgtattgcatattccttcgaaggtaatgtaagagaaataaattgtagtgtattttacactaaaatttatttcttataaaaaaatctaaggtagtattaaatatgcatgttatatgtatgtattgtatggaataaatgcagctacactgtataatggtacatacggtgtagggctgtacaaatttggcatcctatttcaatattaacgactactaataaatgttaccattggagttattacgtattgattattttgtatttacgcgtaaatagctaaatgtttccaattgatgcactaagtgatgcaaacaaatgttccttcgtttatttttttaggacaagatgaaaaaaaaaacatttgatttatcaaatatacaatcaatcaaattatcgattactcttttgatttaagagataaaaaattaggaatttttggacttttttttttatttactgaaagaaacaagagcacaattgaatgtactagaaaaatcaattaataaaaatggttagttgttgaaattcccttgattccatcctaagataatctctttctcgtcttaatatgtgattcaatttctcttagttagctaaactacaattctttggacgataaaccattttttgctaatgataagctctaatcccctcatgtcagcaaattaaagaaaggcatggaaaattcacacaagtgcatacaatcatcagaaaaatgattttttttaagaaacggggagcaaaagtctagctaatgggattcatatatctcaattctgttgacactttaatcttattaacactatatcgttcactctaaaatatcattgatgaaaagatgaacaaaacacttggaaggatcaaaccatactccatcaacatcataaaagtgatttattaagagggtgttgtttgaattaaattgattttgatggtgtaatatgatcaaaacggatttgaatgtctatatacactaattttctattacaattagttattttgatataatatatatatatatatgtatatatatatatatataattaaacccaaatgtgccaatagttaaactgaaatataatatttccttttactaaatgatttatcagactattatgttatgagtacaaggaataattagataaaatacattcaataaaaaacataacaactagaatctataaatattgcaagaattttaattatgtttttaaatcaataaaaaaaaaacaaacatatgcgtatgagagtattgatgtgaaagtaaattagacaaattctaactagaatttattttgaaagaagtagaagttattcctactttaattccacccaccatatttttttcaattaaaattgattatactaaaataactaaacatgtaaaatctactatctattatgttatactatttattcttatttataagactcaattatctaatccattaaaattaaaaaataattaactaagttgatagtaaaaaaattgttctaaaataatatgttttcaaaaatactattgtcattaatgtttctctctcttctaaatatatatgctaatataatttctctcttatttaattaggaatatttttatagtctaaaaataattgatgcatgggataatatggattataatttaattaacactaatatgtttttgtaataattatggtaattttttattatcgtggttttattaaattgtcataaatattttttataatgataataaaaatgttaacttaaatactaacatattaataataatatattatattaattaaaatataataattaaatacataaaaaattataaattgtaaaattactacaggtggagtcatgagccatttaactagttttagataaaattaaatttgattcatctcaccatatttcatgataattttaaagccaaaatccaaacacactataattaatctatgttatcttttccgtaaactacacatacaccatgtcaaagtctttttctttccatgtggtttataatttaggatttaggattcttattatccatgatttaaatcctaaatcttaaaccttatatatatagttacatcttgcatatatgagggacaatttagtatgaaacaaggtgtcaagtgtcaacaactaattcaaagcaagatttgaaatattttgagtaaaatatatgtttagactctatactttgttgaatattatttttagtattaaatctttcataatatacattttaatccgtaatctgtcaaagactagcgtgggagaatataacatgtcttccacaatgggaaagtgaatttccaccattagagttattaaattttaatcccatggatgagtttttttcttcttttttctttataatcttttccttttcttcttgatctcccgatttatccctctggctttattcatcaccattgctgatttcttccttttcttccatttttcttgtatccgacaacgacacctacgcagaaagtaattttcggcaacccctccctttcctcctttttccctattccacatccacagatggtcactacggtggtcgagccacagagaaaacaaggccaggttacaaatattacatatcaacagtacaataatttccttgaaactgcaatttcaaatataatcacaaatcgttatataaaatgtcatgattttcaaaaccaaaatctaggtcttttattcttccaaattggactcaaaattgagagtaaaatggtatagaaacaacgcttatgcaagaaacaaactcgtaacttggcacccatgagaaaaaatcaacacgtacacaaaaaatatcaaaaagctcaaaactttgggagactaaaatctgggtttgttcaaatgaatccaatttgggtttaagtgaggcaataattatatcaagctttgtgactgtttcgtcttccatgctttttctcctgttgaaatcttgtggcagaacaccgcaagaaaaacggcgaaagaccctctcgagttctctctagtttactccgcacaacggtcaggcaacgacgcatcaacatccccactatcatcggacgtcatggcaccaccgttgccgcttagatgaagagaggaagaatgggaaagaagagaagcagaaagaggaaaagggtagtacgggaaagaggaggacaaaaaaggaaaaataataataaaagaagaaaaatttacggtcattgatttttaaacaaggtaatctgatggtcataaaatactttctgaccgtaagagacccattacactctcgagacctcgaccacagtgccaccttttttaaaaatatttaccaaaacgacatgcgggcaaaactatttgccagaatgccacgcgacataattcgctatgcaccacagcgaactatgcttgctgatgtggcacactctgggtggctgcatagttcgctatgaaccccagcgaactaggtggctgccccacgggcagtccacatggcgcttaaacatagttcgctggccccccaagcgaactacgtggactggaattcaaaaaaagtgacggttactgttacgtgtcagcgccttacatagttcgatactaccattagcgaactacgtgttgcgaattcaaaaaattggccgttacggccacgtgtcagcatctggagtagttcgctaccatgcctagcgaactacgtccacgtggaccacaatttaaaccccaccccctgccggtcccctcttccattctctccctccttcgaaaattttaaaaaattttgaaacttcttctctcttctctcacattgtgcaaaataacaagtaagttgtgttgattttaatttttttttgtatatttaattgatattatagttgttatataatatataggttgtaaattagcaacattaggttagaggacttttatgtttgatatgaacattgttaatttatagggtaaatgattatgtgagactctagggtagaagaccaatagtttgattaggttctaaaatagcaacgttagattatataacatgttgaaactctagggtagaagaccaatagtttgatatgaacattgataatagggtaaataattatgtgagtttttcattgtgtggatgttaaatgtaatttacattttgaattaatcgttaataaacatgatttatttcattatgtgaggattcattcttttaaaaaatcattttgaatatatatttagatttaattaatttgatttagtgatgctcaattcgaagtaatttattaaatttgtaattgtatatatcctattttgtatttttcatcatgtgaaatatgtaaaacaccaaaaaagaataattataattatagttaaacatggtaatgtaagtaaaataatgaattatgtaaatatatttaattaaatatttaaacataaatgtatgtatactaatttttatttattaacaatttaggtaaattaagtaatatataagagcgtatgatttttttagttatttagtctttaatattgatataatttatgaaattaaattgactacaaagaatatatacgattaagaattgaacatatttaggtaatttaaaataataatattttgatgttttttaaataaaaaatttaataatattacaaataattattttgaatgagttgatgtagaaaaaaaatatttattaccgtattatagtttgttattatttaacaacgtaatcaagtgattaaatgaatataggattagacatagagaaatatggatcgcgatgagagtgtcccggcaccgccagcgggtgaggatgcgttgggcgtcattgatgagcaggttgacgaccccgaccgactagttaggcgtaatccggtcaggggagcacgacatcgatgtcatctgtcaccttatgagcatgacatgactcgatgtgctgcatatcatggggaccatcatgatgcctagtgacatttatttattacgtggactatgttatttatttagtttcgacgtttgtttttttatattttgtaacttttaatattttgtgcgtttgtttttaatattttgtgggtttatatttgcgcgacttctttaaatagcaaaccttcgtacacgttaattaattatacatacttatttgtacacgttaattaaattatacatactaaaatgcttataactgctgctgcaatcgtgtaggacagttccgtttgttgtgaccaaccaccttataatagccgcatcttaatcgtgtggttgatccttctcgcgaatccatctcgttgcgtatgcgtgttgtcacatgccttccttttgtgcgtctcagtaaaacatcaggcaaaacggtgggttgtctagaaggtggtacgaagtcttcgtttccaattggataccactgagacgaatatacttcatattgataacgaacactgtacacagggtgaatgtactgagtggggtcgatgtgcatggacctgcatgctgccaccacatgactgcaaggaaatttgaatgcactgaactcaccatattgacatacgcgttctgctaacgacaacgaccatttctttccgccacgttgagtgcgaatgttgaacgactcctgcacctcaaatctatcgtggtttgtgtcgtaagcaacaacactgtgtgttgcggatttatgaaccatcctcagatatttttgccacgctaattttgcaaaatgattacctctggccatctcttcaagggcctcacccccatgttgcaaaaaatatgtcactagctgagcgtatgtaaaccgcacaagcgaagtaataggaagatttcttgcgcctttaagaaccttgttaaaaacctctgacatattggttgtcatgtgaccaaatcttcatccatcaacatcataagctacggaccacttctccttcgggattcgatcaatccatgcggctatctgaggacttgcttctcgaaatttctccaatccgacatcaaaatctaaacgcgaggttgtataacctacataaacaaataacacatacatatgacgacaaacttaattatgcataatgtacatgtaaccataaaacgacaacagcgatggcttacctaacattttcaactgcttttttaagatgacatacttgagcttgtgattgaaattgctcgctaaatgacaaatgcaaaacacatgatacaccctcgggggatgccaaccaagctcgacattgttcaccgccgaaattatgcccgcatggcgatccgaaatcagacatattccatttttttgcgtaacatgaatacggataagtgccaaaaaccatgaccagttgtcaatatcctccctagagaccaccgcaaatgctagtggaaggacataattgttaccgtcaattgatgttgcaataagcagtgttccctgatatttcccgtacaaatgggtaccgtcgatgctgataacgggcttgcagtaattaaaagcatcactacactgcttaaatgaccaaaacaccctcttaaataccctacgactttcatccagttgtccatcgacataatgctctgttgtttccaacttaaaagcagacccctgagcaaaatttaacatataactcaaccactttggcaggaatgcatacgattcatcccaatccccaaacaccttaacaatggctttctgctttgccttccatgccttcctatatgatatatgaaatcctagcgttgttgaaatcctttcctgaattaagctgattttaacactagggtcctccctaatcatttctgcaaaatgtgacataataacatgttcgtaaatctgtttgcctaaacataaaaattattgtataacaattataaagtacctatgatcaacgaacatatgaaatttgagtctagctgcttgtgatcctgagacagattaacactaacgcacgtgtgctcattgttccatatgcctacaacccattcactggaagcctttttttggtatgccctcatcctccatggacaaccgtcattatgatattcacaaacaataacggttgtccgatgctcagccatacaatattgttttattgccatttgcacatcaaacttgctctcaaacaactgccccttgtatagcgcttggcccatctcccagttaggtacttgcactccttccatgtcatctgcctcatcatctgggggtgaccaattaatatttgtgtaatggcctacgttagaccaaaatggcacactgccctctcctgtacaatcatacatttaccacattgttatgcttaatctacaaatattaacgccaacaatattaagtaacacacaattatgcgcccatacctgaaatcggaggcaaattttgcattccaacaacccctggagaagggatttcaaaagcatgatcaaaatcaccgtctacgtccgtatccgatgagtcactatctggaacaacaccttcatcaacctcttcctcagaactatccacgggccaagctgggttgtgggttggcaccatttctgtatcttcaaaatcaatttcctgggatggttgggttggtggtggtggtggtggttgtggtgatggggatatatttctttcttccgaattgaccatcggcactaagttaaggtcaattgaccccatgtttgtagcaaattgttgactgcttgactgtccaccggaatatacttccgcatacaattctataaatctgggattttctccatcggatctgcatgcatcagtaactaagattacatcttcgtcatctacaatatccacaccgacccactgcaccgagttgccagatgcacatcgcgcactaagtcgagatacggagtgtccccgttgtaagcgtaacttcttgtatatcattctcatcaaatgatcatagctgcatgctggcggaatacggaacattttgctttctccttcgaacacttgaccatttggtccgacgtatctcctcccattgtaatatacaatggtgattaaacccttctctctcccactcatgttttcaaattcgagcctataccaaagaaaaatattctcaagaggaaaacgttctcggaacaacatgcaaactggagggggcgtgctgtcattaaataggtgggtgccacagaccaagctcgctaggccctgtagcgagctccgacttcgctactctgacaagcgaagtatgtatgtgccacgtgtcaagcttttacctagttcgctacaaggtccagcgaactccgcgctgtctgccacgtgtcatgcccggtctgccagggcactgcgccattgctcagagtgtgccacatcagcaagcatagttcgctggggtgcatagcgaactatgtcgcgtggcattctggcaaatagttttgcccgcgtgtcgttttggtaaatatttttaaaaaatgtggcactgtggtcgaggactcttacactctcccattatagcttgcgtcttcctaaatttacggtcattgatttctggttgttgtagtgagtttaataaaattcatacatttttcgataataaaatgcatctagtcttgctttgaattcaatggttattggagtagttgactataactagtataaatgcgtcaacggaagttagataaatatataataaatatacaacaaccgctatcatatcattgtacaacgaagaaagataatattaaattgagagtaagttaattaacagtgtcatgatagctgagtctcgctaatccccacaatttaatgaatataattttttttataatggatatattttttactgttaacaaatttaatgaatatatttatttactttaaaaaagaattaatattataaatttagaaatcattcaacttaaaaagcttttgaaaactgtagggttgaggtgttgaacagattgaacattgctgtaatccacaaaatgtcatataggaaataattattttacgtgtaagttggaaaactaattaagggctattgttttaccaccatatataatatgttcaagcttcgcaggctggaaagaaagaagcaacacttatagaacagggaatttcagagaggtctccaaatcacttcatttccctagaattaaatcatgaactccaatatcgaagtttcagctgaccacataattcagattaatcaaagtcatgagcaaactccaattgccacttcaacaaactcgccggcaccaaaacatgaaagtagaggagtgaatgaaatgactccagaagagctgagtaagttatacttgaaactattgcattcacaagagggtgcatttcagagatcatgtcttaagagtttgtttattttacattttgaaaaaaattgaatttgaaaccacttgacgttaacaaattatatttatattattattatacgaatgatatttcaacaatgggtttagaaaattattttttttattcgaaagataaaaaaagtagaatcacttttaaagtgagtataaataagtcacatgttaagatcaattagcttttgtcaactgaagaaaataaaaaataaattacttctctcaaaatcaattttacttatcgtcatagaattaattttcaaacttaattaaaggtgattgatgattggatcccttcgactactacataatctcaaatttctcaggtaaatttcaatttataaatgatgaaattattaagaattcaaaatttgagacaagtttccaagagaatttttacagatttagggtaaacgataaattaaaatggtcttctttgcaactaaatacaaaaagttatgattattaaataaaggacatgttataatgtgaagtttgaaaggattgcaggatctttaaaagaagatctgaggatacatatattgcgggatgagtggctggaatcaaaatggattattgagaaatgtcctgatatggtacgcattccgttaaatgatagtgaagacacagctcttcatctagcagtatattacgaaaggcttgaaattgtgaaagagttggttaaccgtatgagggcagaagacatgcgaatacaaaactcaagtggagacacagctcttcatctagcaccaaggaaatacaaccttcaaattgtgaaagagttggttaaccgtatgagcccaaaagacatgctaatacgaaactcaagtggagacacagctcttcatctagcagtatattacgtaaggcttgaaattgtgaaagagttggttaacggtatgagggcagaagacatgcgaatacaaaactcaagtggagacacagctcttcatctagcagcaagggaatccaacaatgatattgtgaatgagttggttaagcgtatgaggccagaagacacgctaatactaaactcaagtggagacacagctcttcatctagcagtaaggagaggcagtcttgaaatagtggacattttgtcctctcagaaagtgcttgagaaaatggatttcaaggatattgaactactgtttttcatgaccattaggttcgacatgtttggtaagtgtaaaactaattaaacaaccttatttctcctttttgtaatctagttctcttttacatattatgaagttttacaaattgaatcgaacccattaaaccgatcagataccatatatataaatataatgtttacaattccaacgtcattcgatacacttgaccataattcaataacaaatttaatgagaatcagttgaaataattaattatgaatattaggtttatgaaagactgtgataccatcctttaaaaccaaacagctcctagctaaattctcattgatttcatatatatgaaaggagatatatatgaactcgtaagtggtttttcaatttagttggagttttaatttaccttgccttatactatttaatttgtgcatataacagattcggcgttgcgattatttgaaaaacatccaactactctggccattgcaagaaatgaagaggacattacagcagtgaagatgctgggggaaaagcctagaggaaagtcaggtaacctttcacaagttgaaaatggcttttttattttttttgtgttctaagctaaaatttagatcttatttgacatcatttccattttgattttagaaagttatatatatttttgttttatataaaaaattaagaattagtccttaattatctatatccagtgtaataatggtatttgatgtttgttgagttattctaataacacaaattaatgtttgccaaggaatcagaagtttgtgatcggctatttggagaagtattgactcaagttgaaacattggaacagaatcgtgaatatgcaataaaatcaggagatgttgagactgtgaagatgcttcttggcaataatcttagattagtgacttatagggaccgcagaaatgaatggaacctactgcacttggttgtgctatttcgacaaaaaggcatatttaatattataccaccggaattaaaagagcttctaggacgagcagtggactatggaggtaacaacattctacacttggttgcgcgtcttccacaaggtgaattcgaagaattgtccagtttaagagcaagcattcaaatgcaaacagatatcacatggttcaaggtcaattagtttgcttagtttaatttctttattcaaccattctttattcactcgcatgggatccatcagttctagcaatcttattttaaaaatttaaaattccaatgttaactagactgattttaaatctttaaaagtaacaagttttaattaaaaatataaatcattgtatgtagtatttgttgattattgtaataattttttaaaatttgttatccattgtctttagcataatagttaaacagccaatatataatagaaaattttaattaaaaataatacaagtgcatttgtaaaaataaatatcacccctaagatttagtttttaaaatatcttaactttgaaattgtattttttacaaatttaataagtaatagctatttgaggaaattacaataattttcctgagatttcatataattatatgtaattccattttttatttttctacactaatttcatttaaatttgaaaaattacactaacatctcttaatatgtttaaaaatattacaataacatccccttaaaactctaatatctcaaaaaatatttgtgtgattactctaaatcttagaaggtgtggttgtaatttgctctagttattaactgataattgaaagattaattaagttatgcatttggataccatcatttacatatactcttgatttgtaaatagttagtgaagcggaattttcctgatgatgaactaagaacaatgagaaacaaggcgggcatgagaccaattgatgtattttataaggaacacaagaagttatctgaagaaattaaggaaacagccaaaggaatagccgaatctggcatgcttgtgtcaacacttgttgctaccgtagcatttgcggctgctctcactgttccaggtgataagaccaatgcctggtttactgtcttcatattggcaaatgcagtcgcattattcacttcttttgcgtctgtactctcattcttgtcaattttcacttcatcaagattcgcacaaagcgaatttgtgaaatcactacatcccagcttgacttttgggcgttggttacttatggtcgccgttcctgctttggttgtggctttcattgcagcctccattttgatatttgaacacacttccaagtgggtttcttatgtagtggcttcaatgggggttttcccaatacttttgtttcttttctttcaaattagctttttcgacgaactctggtggtctagattttatggttttgaaaaactggactgacttattacagagttacagacattggcataacttcaagacactgtattgttatttgtttgtggaacaatgaagcttgtgtttaaatttgagattattctacattttctatctcatgaaatattacctttcttattgttcccgccttaatttgagactatactgcataacccacgtcaaagcttttccccttccttccatgtggttggtgaagggagcaaatcataacacagaaaaagctttttttattacaaattcatctttcactgagacttaatcctagcggcctactccatttgaaaagaattactatatacaacaaaattataatgaatataaaattaaaatgaagagaaatgaagtaataaaaaatattgttgattgaatgtgttagaaaatgagaaatgaaattataattaatgagtcctaaccaaaccatattttttagcaagtgacgtgaaatggaaggagaaatggttagcagtgttcttttacttatgtttaaatttttaaaaataaaattattgttttataacaaaatatttttatgttgagaaataaccaaataattaaaaagttcaggttttcaaattaaattttattttttatttgtatgaacattttttgcaataaccatgtttttgttttctactctcttatttattcaaacaaataaaaatttatatattttgttttttttatttttattcatttaaataatacatctttttcatcttattttatatttatttttagataaaagttatgtatggagagtgtaaaaagatttatatagtcatccaatcacaactcataatgtatatataataaatttgttaatttttaaaataataatttatgattaaatgataatttctaaaatcttgaaattgttttatactgttaagctgttagtacatagtcattaaactttaatttctatctctcttaattcttttccatttatctgatttctcatcaaattcaagataacaaagaaggttcaagtgcaaatcatgtcgtcggatcagtgagttaatttgctccgcagatttgctctcaaattgtactcgagaggaaacgtcgtgtgatacaataacagacttgcatacacaacgccacaatcaaagctaacaacccaaacaaaatcaaaatcgtaagtttaaggatctgaatgtagtgcctaccataggcaagacctatatgagattaaaatttctcaaataacaataccgtggctatttctaattggaacaatctatatctccacttttatcctaaaacaaagattgtaaggactaaagttttcaatgtcctatccctcctaatcttcctaacactaaggatttgtctaatactactcctaaaaattctactctaattctcaattagaactttctaaaccaaaacaggttcatctacatttcttcatcataatcctcttcatcttcatcaatccttccatttaagttaattagctagttgcatggaatcaatgttcattttttccatatcagacaatgaccattcagggtattcctcatgcttctcttctgacattgatacccccttcctctgccactgcaatgccaggctctgtccaaatcatgaagaagaagaaaatcattattcagataatatttaacatcaagctgctgcgaggttctttagaatgttgcatctctcagctagaatttccacattatgtgttagttctgattctatagtgaatagtttgctcaattacaacaacagttttcaccaaaagttttaagaaaaccagatagttttggttctttgtatagtaaggtttacagactattaaatgtacttgtaatcgcaagtcagtgaagcaacttgtgaatttcccgaatgactgaagtaaattcttttgtaaccagcaaaagcttcacagtctgcatgacatgagataattactaagccgaaggtttagtcacaaaagaaaaatttaagccaactcagtctgaattgatatattaccttgttatttctcttgggatcgtcgtggctgtcattatcatcatctttcttaatataaaataaataaacaaaattcaccacacagaaaacatgttcctagtaacatgagtattaatcagagcacaaacctcttagtgacagtatgatcatcaccagttacaacagaaccacctaaatcagaaacccttctgacaatatcttttagaaaatcaaagacattaaaagtctgcactcactgttttctgcaaaggcaaggatgcaagtaactcagacattttagaaactagaaagtgaaggtaaacactagaacaaacaacacatgttccaaaaccaagaccatcccaacatttaattttcttctgtagatgtcatttacacgtctaatcatgggttttatcaccgaaagtggttaattttttttgttattatcatttgggaggtatattttaaattttttatcacaaagagatatgttgtaagttgtaacacagattacgacttatatgttttttaatttttttttagactgaagtcataaaaaattatacgacttcaatataattttttttaacatataactttaaagtcgtaaaaaaaatttacgtgtaacttttttttacagttttttttaattacgacttcaaaatcataattttttttactattttaaagtcgtgatttttctttctttacattttttttgttttatttcttcattttttactttttatactttttttctttttttaaatgataatttaaatatatatatatatatatatataaataactttttaatctaattatttaaaaaaaaaccctaggtaataacaaaaaacaattacctccttccggtgataaagccttaatcatgtttgtgcatgtgaaacatagaagtcaaaagagggaaatttaatgagactgagcacattatcattaaaattgcagatccaatcgttctaggctgataccaaactcagatgggatgcttccagttcgcttggctgttttatatggacacaacaaaatggtgcaaattttgtcctcttagaatctgcttcacaaaatggtttataaggatattcaacgactttttttatgaccattagcagcaacatgtttggtaagtgtaaaatcaaacatcctttgttttatctagttgaactcgtacgtggtttttcaattttaaccttgccttgtacatatgcaatccaccatttcgatatatagtggattggtccaacaaatgtataacatgagcataaagaaacaagtaagattaaagtttggtcttatatgaaacatcaattttttcatattccaagtgggttttttatgcagtggcttcaatggaggtttttccaatacttctgtttcttctctttccatttaacttttttgacaaacacttgtggtctagattttatcttccatccgaacacttgccagtgtctattacatagttatagacaccggcaaactcaaacttcaagtatatgtcacaaccacttattatgttaagaacatttagatcgacattttaataagaaattatagttattccaaactttgagattgatccccgactattctatgtttcctaggacttatccatattaaatataaacttcctttatctccaatcagggacggaggcatgtaagcatgtgtatctagagctagtatcatgttaactgtactttggaattttagtttcaagtctttcttattagtattccaagtaaattcaaaaccataaaaacattttttatgttccaccttagataacgttcacctcatggtaggcacaagtcccacattggatagttaattattcaaatcattctttataattgtctgatatgtgtctttttagccaactcacgctcataactcaagtgatgttcttttgttaaatttgtttaaatttatttgttgaaaaaatatttattttaataaaataaacaattttctgtttttgaatgtatttgtttaaattgtaacagctttttttgtttattttgatcaacgttatttgtttaactgcttattcaaaaaatatttattttaaaattacttattttaagtttaaacaaactagtttgaggcgagattggttttacaaagaagcgattagtggtgcttatatattaaaaatcaaataagtatattatataataaaaaataataatcttattagaaaaataatggaaataattttaaaaaaatgtataattttttcaaacaattcatctgtttgtattttctctttcattgtccaaaacaaacataaataatgaatttctacacttatttcctttctatttttattcatctaaattacaaatcttttttactttatttcgtatttatttctatccgtctaacgtcttattcttttcctcttgtctcatcgtgcaataagttcacgataacaaaaattcaaaaggttgcatgcaaatcatgttgccggagcagtgagttagttccgctagatacaagtgtgattaagataggcatccccgtaaaattttgagccataacacacccaaaatctgaatgtagtgcctaccataagcaatacctacatgagattaaaatatctcataagtcataactatactggcaaatcgctatttctaattggaacaatctatatctccacttttaacctaaagcaatatccctcctaatcttcctaaactagtgaggagtaagtatctaacactgctgctacaaaatctactctaattccccataagaacattctaatgaccggcctatatgagaagtaatgaataaaccaacacaggttcatctacatttcttcatcataatcctcttcatcttcatcaatccttccatttatgttggctagttgaatgggatcaatggtcattttttccatttcagacaaggaccatccagggtattcctcatgcttctcttctgacactgattttgcagatgaactagttgggacagaagttggtgtgtctaatgaatccatatcctcatctgggttcaaatttaagtcaaaatttcgaatggacacttcagccggtttgcttactggaaaactctgcttaacttcttcaggttcgggcacactttccatgctttcattgctttgagtgtggttgtcattctgcttcaatacatcagaatcatcttcacacttggcatgtgaactcatcttttgatctacagttctaattccacggccacaacccctacctctgtccctaccccttcctctgccactcttatgtccaggctctggctgtgcaaatcatgaaaaaaaaaaaaaaaaaaaaagttccataagtcagataatatttaatattaaacagctgccaagttctttagtgccaattctatagttttcagcaaaagttttcagaaaaccagacagttttggcgctttgtgtagtaagctttaagttgaagtgtggcctagcctcacagactattagacatttagacaaacgtgcattcacaagccactagtgagtttccctattgaccgaagtaaatttttttgtatccagcaaaaggttcacaatgtgcatggagaagagataattactcagcaaaaggtttaatcacacaagaaaaatttaagctaaccactgttgaagtaattgaatacagttgataaattaccttcttttttctcgagctcctcgtcgctgtcattttcatcatctccggcaactttcctaatataaagtaaacaaagttcagcatactgaaaacttgttccaagtaacaagagtattaaccagagcacaaacctcctcttagtgacagcatggtcatccccagttgcaacagaacagcctaaatcaggaactttgctgacaatatctttcagaaaatcaaagatataaaagtctgcacacactgttttctgcaaaggcaaggacgcaagtaactcggacattttagaaactggaaagtgaaggtaaatactagaacaaacagcacatgttccaaaagcaagaccatcccaacatttgcttctgcagatgtcatttacatgtctaatcatgtttgtgcatgtgataaatagaaggcacaagagggaaattgttttgagactgatcacatcatctttagaattgcagatctgatgttcttataagtacatagtaataaccgccctccaaaagaaagaaacctgcagccttgtaaccaccttgaacagacttgacatagacaaaaatttgaacaaagaaaataatagaaacttcacttacaaatgaaaagcattcatagtctttgcccccctcctcaaagttatctcatatgttcgatcacacaaatcttgcagaaataactctagtgctttagctgcaatacataaacacaaataatcataaatcagagataattcatagaaactcccaaaagcacaataaaaaataaaaaaataaatcatttttcaagagaagaaggaaaacaccctagaatatgcatgaaagataaagattacttacaaactagaagaggcacagccattgcaatcttccctacatcctcgtcagcttgcataattttcttaatcctagcgtgccaataatcaattcaataagattacacaatcattactaaaatgtctaaaactaaaattcaggttatgacactttataagtttttattttattttattatttatatgtttatgaaccaaaaattgtctatccctatgcctatcaagtaacttgcccctttattttattcattggcaaagaggttgagtgaggatcaatgaggacgaagttaaaaaataagatgagatggagcaatgaaagagagtgggataaaaagagtgtatttgagggtgtgatgactctatcaatggaatgaacctttggtgaagtgccatgctgccttaaaaatcaattatgagactatctctacggatatgttattatagttccaaccaaacaaaaatgaaatacatacttcaacaaataaagttccctcgcgaggacttggcgcccaagcagtgaaggacctcttttttcattaatttccagagaggaatttagatcgaataaagcgataaacacaggaatgcatcatccaatttaataagacaggtcactaatcatatgttgtaactgtcaatagaaattcgggtataaaatttctatatggtacaaccttaaatcgcaaatagttttatccatatccgtattggatgacaccctatcttttctgaggctgtttcttttcgtgagttcacatgataaaaacatatatacagacaatatcacaattagaaatattaaagatattaatttaatgtggttgatcacctttttatatttttacgttaacatctcaccaaatattcaatattacaaataagattataagatttctttaatttctttttacttcttttaatagcaattagtggatttaatagtagttagtagttttaaataaactataaataagttattccaaagttatatttttttcttttagtataaaaaattaaaaatatattatgattgtaagttaacactctttttatatgtttttaattctttaacatttttcctgttgtgaattttagtcttttaacttttttcatatttagtttcagttccttaaaaggatctaaaatacggatgaaaaaatttaaagaactaaaaataaggatgagaaaaaaattaagagattaaaaatataaataaaaaattcaaagactaaaaagataaatttaaaaatttagaaactaaaaaatagcttatcttttttattttataacgatgacaacatgcatatttattgaatatcaagagaagtacatttacattaattaacatcaaacaaattgtgtaatctatatttctacggttctactaactttatttccatcacgtttagttctatggaaattaaattgaaggctttactctgaactgtgatgttttctaacactagtcctactgtgggcaatgtggacttcacgtaaagtgatttaaagatcaactgagtcaccttctacgacaagtgtactagttgtacaattgataaaataaggagaaattattgtatcaataaaaaatttggtatcaacaatacaatcaatgaaattatcgattactcttttgatttaagagataaagaatttggaatttttggacttttttttttatttaattgaaagaaacaagagcacaattgaatgcactagaaaaatcaattaataaaaatggttaggtgtaagttgaaattcccttgattccaccctaagataatcttttggtcgtcttaattatgtgattcaatttctcttacttagctaaacttcaattcctcggacgataaacccttttttgctaatgataagctctaatccccttatgtcagcaaattaaagaaaggcatggacaattcacacaagtgcatacaatttacttctatacttggactgtgagctttgaatcgattggtgctctgaaccaaaacagagagattgcaccaaattgttcctgtgaaccaaactaaaccaaaattagtttaaaagaattagtttcaagttttgctaagcttaattttatgaatttaatggttgtgaaaagcttaattttatggatttactcgggcatcataatgtataaaagtttcaaaataagctcttggatggatatttaattaatattaagctgttgattcattcaagaaaattgtttttgttcagttctttttctgattttgtataggtttgcagtttgccaatgtttgtaattgacacttgtttgttgttgctctccaacaacttcatggtagcgcggagaaattggagatttgtaagaaattaagttgttgctctccaacaactatatgtagatggttcaagtcaaggcaagaatatgattgaaggagatggaaaactaagcaatgtcgacttggaaatagaagatgaatgtacaatatgcttaaaggcgggcaccaaaatgattttacataattaattatggttagaattgattatataataatgtaatttttgtttggataatagttattaaaaatgatttttttaagcaacggggagcaaagtctagctaatgggattcatctctcaattctattgacaccccaatctcatttgcaccataacattcactctaaaatatcattgatgaaaagattaataaaatacctcggagggtcaaaccataccccatcacaacatctgaaaatggatttattaagagagactgttgtttgaattaaattgattttgatggtgtaatgatcaaaatggatttgaatgtctacatacactgatttcctattacaaatagttattttgatatatatatatatatatatatatatatatatatataaaattaaacccaaatctaccaataattaaactgaaatataatatttccttttttaaaatgatttatcacactactatggttatgagtacaaaaataaattagataaaatgcattcaataaaaaaaatataacaattagaatctataaatataggaagaatttttattatgtttttaaatcaataaaaaaacatatagatgcatatgagagcattgatgtgaaagtaaattagacaaaaactaactaaagttattttggtagaagtagaagttattattcctacttcaactccatcataattttttcagttaaatttgattatatcaaaataactaaacatgcaaaatctagtatctattatatctactatattatatactacctccatgtctatttataagattcaattatttaattcatcaaaattaaaaataattaattaagttgataataatgaatttgttctaaaataatatgtttttaaaaatactattattattaatgtttctctctcttctaaatatatatatatatatatatatatatatattaatatgatttctctcttatttaattaggaatcttttaatagaaaaaaataattgatacatgagataatatggattataatttaattaacactaatatatttttgtaataattatggtaattttttattatcgtggttttattaaattgtcataaatatttattataatgataataataataaaaataaatgttatcttaaaaagttataatattgtaagaaattataaattgtaaaattactactgtgcaagtcatgaatcatttaactagttttagataaaatcaagtttgactcatgttatcatgtcattatgttcattcataattttaaagccaaaattcaaacacattataattaattcatattatctttttcgtaaactacacatacaccttgtcaaagtctttttctttccatgtggtttataatttaggatttagggttcttattatccttgatttaaatcctaaatcttacatatatagttatatcttgcacgtgggataatttagtatgaaacacggtgtccaatgtcaaacaactaatattttggttaaaatatatgtttagactttgtactttctttgaatattatttttagtcttaaatctttcataatgtacaatttaatccctattctgacacagacgcttgggagagtgtaataggtctcccatgatggtaaagtgaatttttcaccattagatttatcaaatttcaaacccatggatgaatttttttttcttcttatttctttatttttttccttttcttcttgagtttcccgatttatccctctgacttattcatcactattgtcgttaaccactatgtgccgttgccaaaaatcacctctggcgacagcatttcatttttttcgccttccttccattttcttgcctccgacaacaacacctacgcagaaagcaattttgggcaacccctacctttcctcctttttccctattccacatccacagatggtcactacggcggcagagccaccaccacccatcacatatctgaacatagaaaacactgccagattgcaaatattacatatcaatgctataataatttccttgaaactgcaatttcaaatataatcacaaatcgtcataaaaaatgtcatctgattttcaaaaccaaaatcttaggtcttttattctcccaaattggactcaaattaaaattgagagtaaaatggtatagaaacaacgtttatggaagaaacaaactcgtaagttggcagttggtacctatgagaaaaaatcaacacgtacacaacaaatatcaaaaagctcaaaactttgggagactaaaatctggtcaattgaatccaatttgggtttaagtgaggcaatagttatataaagctttgtgactgtttcgtcttccatgctttttctcctgttgaaatcttgttgcagaacaccgcaagaaaaacagccaaagaccctctcgagttctctctagtttactccgcacaacggccaggcaacgactcattaacatccccactatcaccggccatcatgacaccatcgttgccgctaagatgaagtgaggaagaatgggaagaagagacgaaagaggaaaagggtagtatgggaaagaggacgacaaaaaagaaaagaaaaattataataaaagaataaaattttactatcattgatttttaaacaagttaatctgatggtcataaaatactttctcatgataagtgattgattacactctcctctcctgttatagcctgactctttctaaactttataaaaatgtgttggacaaataattatttttatttataaatgtgtaaattattgataaatttatttcttaaatatgaaaattttaatttaaattattaaaagaaaaaatgtgacaaatttatttatttgttaatttttgtttattattattaatgaaaaaatttatgttacttaacataaaaggattaaaatgtcaaaaataattattaatatgactggctgcataaattattgaataaatttcaccaaaatattaaataaatatttttcaggcaaaagaaccaaataaatacaaattaaataagaaattacgcatttggggcaactttcaaactatttacaaatctggggcaactggtcacgcccagaaccaggcgtgactaggggggtagtcacgcctggttctgggcgtgaccagtcacgcctggttctgggcgtgaccagtgtgtatatataccccagattgcactgttcactcacttctagcttttgacttctctctaaaagcttctctctgtcttctctctaaaaagttctctgatttctctctagaagtgctctaggttctctctaaaagtttggaggcatcagctttcttcggtttccagcaacgaagctgtgtgacaagtaagttaatttttttttttaattgtgaatgatatttaatttattattttgttgatttaagttagttaaatttaatttattattttgttgatttaagttagttaatttattgattattagttatatttagcacatgatttattttatgttgtagcaaactgttagatggtaggatatgatttgcactagtttagggttatgatttagtattaagttaagggttacattttatggttaagatattgatttagtgttaggtttagagttagattttaatcccttaaccctaaccctaaccctaaacctaaccctaaacctaaccctaaacctaaccctaaccctaaccctaagccctaaaatcataaacataaactgtaaccctaaatggtacctttatttgatcctgaagtagattgtcatcaaattttaataattttaggattagaagattatagaaaatcggtaaccctagggaatagtgtttagaatggtttagaaagcgacttcatttggtgtgcatatcaggaatctccgagtctttagaattgcaatgaaaatgacatgtgggtatgggataatcccaattttgatggtgaattagaaccctttggtcgctgctcgagagtctcagagttggtgggtaaggagtgtatacaacagtaatatcgtgatccattcgaaattgcataagaacatgatgtgacaagtactgttgtatacactccatacccaggtaatgttacaaactattttaaattaactactgaaatcatgaaacaccaggacgctgaggacaagctctccgattatgtccaacagccttgcaaatttcgcatctgctgcgtctttgactagtttcgacttcgtccatctcgttccgaattctggtcgcctttggacgaccctttgcacgcaacttttccttgtcgggtatgataaccggaccgtcactcggtggaatagcaccttcattaccaattggttgccacggaaatgagtaggcctgcaccaaattacttatgaggaacacatcgtcaacatactgaaaaggattctgccgaacatgtaaagcagctgttgcggcgtgactgcatgggtatctgaaggccttaaacttgccacattgacaaaaccgcttcccaaggttgactgtatatgacctctcacagccttcctccacctcaaactgtgttcggtcaagattataagtgcgtacgtggtggcctgtagctacggtctggttatgcctcatagcatcaaccacatttctgcaatgtcgcgtcgaaccctcaacttgtgaaatagccgcctgacccctcgttacaaaatattcaaccaatctgctgtacgtgtgtttcaccaaagcagttataagcatgttcctagctcccttcaacacccgattgactgattcagacaagtttgtcgtcatatggccaaatctcctcccctctacatcatatgcacgtgtccactgttccttggggatgctatcaatccattctgcaacctcagggctgctatcacgaaatcgtgctaacgccgcctcaaaatcaaccataaagggattataacctgcaaaacaatcatccgattaacactaatttacttactatacgaaatattttaatatcgtgtcgtaattgttaaccatacctaaattcatcaggttcttcttcaagcgttgatttctgaacttttgattaaaattactggcaatatgacggaggcaaaacacgtgatgagcatgagggggttgccaaccagcatgattcgccacagcagatagtatgttgcggtgcctatctgaaatgagacaaatgttttgcctctgagtaacgtgaaaacgtatgttagccagaaagtatgaccaagcttccaaggtctccccctcgactatggcaaatgccagtggcaggcattcgttgttgccatcctgggttgtggcaatcaataatttccccgtatacttcccatacaaatgagtgccatcaatctgaataattggtttgcagaaattaaatgcctggcaacactgtccaaacgtccagaacatgcgaagaaacacacgctttccccgtaccagtcgatttgccacaaaataatcattcgtttgaatatcataaaaagcacctggtgaaaaacgaagcatatagccacaccacctgggcaaaaatgcatatgattcttcccaattcccgtaaaccattgccattgctttctgcttcgcgaaccaggccttacgatatgaaactctgaatccaaatgtatgggtgatcctttcccgaagcaatgaaatcggcacagacggttcctccttgatcattcctaacaattcaaaagtaacattcacattaaatttaaccattattcaacacatacagaggaaattttatacacacgtacctactaaaattgaggcaataacatcagcatcaagctgtctatgaccctgtgaaatatggtcgttaaggcagttgtgattgccgccccatctcgaaacaatccacttctcaccgaacgccggtttagttaccctaaccctccaggggcaaccctctttatgagcaatacacttcatgctaaacttgttaggcttgctctcaaccacataagcctcttgatgctccttcatcaggttccgcttacatgccatctgtgcatcctttttggaggaaaattcctgtttaacaaacaacggatcccctaattgccatggaccctgcactgaaccagaaccggaaccggcaaaagattcttcttcgcttggatgactccaatcaatgtatgtgtagtgaggaattccatcccaaaaaggagtcacctcagcaccttcaaataccaaatcaattgaataaacataacatgcacactaaaataatataacatacagatatataaatgattttagtcatgttacataccttcaacaggttcttgtgattgtctacctcctacgtccggatggtgatggatttcagatgaccccgcagcagtgcctgcttggaattcagtcgcatccacaccggcatcgtcatcattatccgacgcactagcaccctcttcaagaagacgatcttccatggcaatgttctcatcatcgtcatcctcttcgtcatcatccataacccaagttgggtcatgtgaatcttcctcagacacatttacagatggagcagcacatgacgcagccacatttacaactggagcagcatatgacgatctacgcctactaggatttaaaggaactgacctaatgggtaaaacatcatctgccacagtatactccacgtacaactctaaaaaatctttcgttgccaacttaaaaaattccaccattagcaactttacatcttcgtcgtccgcaacttcaaaacccatgtacttttcacgttgccataatcttcccacaatacgtgtgatacattggttgtcttgcagacgtaatttttggcgtatcttcacatgtacatcatccattgtcgagcttcgcttcaaaagtgtctgccttttttccccttcaaaaacaacaccttctctcccttcaaatatccttccattataatttaacacaacacggacaaattcctcaccacctgaactcatttgtttcactcaacaaaaacaaacacttcttcccagagcttcgctgtacacataaatttcaaaacactgtgttagaatatcttcttaaaccctaaaccctaaactccgaaccctaaaccctagctctaaggcgtataaatcctaattcctaaaccttaaaccttaacccataaaccctacaccctaaacattaaaccctaaccactaaaccctaatctgttaaccctaatgtgtgaaccctaatctgtcaacactaacccctacactccaaacactaaacagcatgaagatgacctaaacgtgtacactaaaccctaaccagtctaccctaacctaaactaagctatacaccataagaaacattttcgacaacactaaaccctaaacactgacaatttcataatacaatatattaactaatatacacaattaatcaaataacttacttgttcgcagagcttcgctgcaaaatcactaacactactcttctgcaactcgattcaacaatgcgcaacactgagcaaagaggggaaactgcatctgggggtatatatacacactggtcacgcctggttctgggcgtgaccagttgccccagatttgtaaatagtttgaaagttgccccaaatgcgtaatttcttatttaatttgtatttaattggttcttttgccatatttttctagtgttgcgttgaattcaatggttgttggcatagttgactataactagtaaaaaaagaccagacttaggatataatcaaagaattaaatgcgtcaagggaaggtagataaatatataataaatatataaccacagctatggcagaaagttttcgtcaacaataaacatatttaataatagatttttaattaaaatcttagaatatctttcatataagattttaaataagaattttgagtttaaatttgatttttattagatttttcaataaaaaaaataaacagattttcaacctaatgaatgaattactataaaagaacccttaagacatatacaatatttaaaaaagaataatttttttccatatatgttcttgatatctcaaaatgagatttattactaaagaaaaaaaatgtaagagatatttaatcatatgtggcactatgggtccaccaaaaagtggtttaaagatctcaatttggaatttaccactaaagatgtttttatgtgtcatttttttggtggacccaatagtatcaggtaggattaaatatttatgtagatctcttttattttttctttaataataaattttattttgaaatcttaagggaggaaaatagaggataaaagattatttccttttgaatattgtacatatcttcggggttattctataagaactcattcttcatgcttagagatctgtttacgtcttttattgagagatttagtgaagattagatcttaagctcaagatccttgcttaaaatctagtactaaagatgtttacatctttagtggtagatcccaaattgggatcttagaccacttcttagtagaccctatagtgtcaagtaagattggatatctcttaagatcttttttatttttttctttattggtaaatcttattttgaaatattagggagagagagagaaaaaaaattattctattttgaatattgtgtagatcttaagggtttttctacaagaattcattcttcatgttgcatatctattcatttcctttattgggaaatctagtgaagaccagatcttgaactcaatatcattgttcatctttagtggtagatgccaaattgaaatgttagaccactttttgatggactccatagtgtcacgtaaaaaattgaaaatctcttaagatttcttccatttttttattttgtgatagatctcattttgagatcttggctaggggagagagatgaaaaaaactattctttttttaacacagtgcatatctttagagtcttttctaagaattcattcttcatattggagatatattcacctcatttattaaaaaaattagtgaaaatcaaattttaaattcaacatctaacactaaaaatatttagatattatattattgtacaaggaagaaaaataatattaaattgagagtaattacactctcccattgtagtatgtgtcttcctaaactttataaacatgtgttggataaataatcatataattaaatgggtcacggaaatatataataaaaatataaccaccactatcatatcattgtataaggaagaaagataatattaattaaattaagagtaagttaattaacagtgtaatgatagcgaatttcgctaatgcacacaatttaatgattttttttttttctgttaacaaatttaatgaatatatttattcactttaaaaaagaattaatattattagaaatcattcaacttaaaaagcttttgaaaactttagggttgaggtgttgaacagttgaacattgctgtaatccacaaaatgtcatattgggaataattattttaagtgcaagttggaaaactaattaagggctattgttttaccaccatgtataatatgttcaagcttcgcaggctggaaagaaagaagcaacactgatcgaacagggaatttcatagagatatccaattcacttcattttccatagaattaaatcatgaactccagtatcgaagtttcagatgaccacataattcagtttataccaaccccagatcacatactcctattaaatatcatcaatccgttaccttttgtatgttatcattaataaaaaaaaaatacataaaaaaatatgataacaacaattaccaacataacaatcaaaatgtgggtaactatcttttagtcttgctttgaattcaatggttgttggagcgagtttaataaatttatacatattccgataataaaatgcatctagtcttagctttgagttcaatggttgttggagtaattgattataagtagtataaaaagaccagagttaggatataatcatataattaaatgcgtcaacggaagttggataaatatataaccaccgctatggcagaaagttttcgtcaacaatataagagtaggaaattgaaggttttaggtgtgtaaagatatcgtatcattgtactacgaagaaatataattttaaattgagagtaagttaattaacatagtgtcttgatagcgagtctcgctaatccacacaatttaatgaatataattatttttataatgaatatttttttctgttaacaaatttaatgaatatacttattcactttaaaaatgaattaatattatataaatttagaaatcattcaacttaaaaagcttttgaaaactgtggggttgaaatgttgaacagattcaattaacatagctgtaatccacaaaatgtcacatcggaaatagttattttaagtgcaagttggaaaaataattaattaagggctcttgttttaccaccatatataatatgttaagcttttcaggctggaaagaaagaagtaacacagggaattttagagaggtatccaaatcacttcatttccctagaattaaatcatgaactccaatagcgaagtttcagatgaccacataattcagataaatcaaagtcatgagcaaactccaattgccacttcaacaaactcaccgacaccaaaacatgaaagcagaggactgtatcaaatgactccagaagagctgagtaagttatactttaaactattgcattcacaagagggtgcatttcagagatcatgtcttaagagtttgtttattttacatttcaacaatgggtttagaaaattattcttttattcgaaagataaaaaaaaaaaaagtagaatcacttttaaagtgagtgtaaataagggcttgtttgggatgtaaacttatttagaaggatttctaaaagaagaaagtaagaagaaaaaaatgagatgattttcttcataagctaaaataggttttttattagctcatttatagatgtcatttcatcttttagagaagctgtattggtgatcttctcaaaattagctaatggagaacttatttttacttatggaaaaaataatttcatttttttcttcttattttcttattctaaaagtgtttttagagaaatttattcaaagagttctaagtgacatgttaagatcaattagcttttgtcaactgaagaaaagaaaaaataaattacttctctcaaaaacaattttacttatcatcatagaattaattttcaaacaaaaattcaaatttaattttcaaacttaattaaacttgatgatgattggatcccttagacaacatgatctcgaatttctcagctagatttcaatttacaaatgatgaagttattaggaattcaaaatttgagacaagtttccaagagaatttttacagatttagggtaaacgagctaaatagtaaaagttatgattattatataaaggacatattataatgtgaagtttgaaaggattgcaagttctttaaaagaagatatgagaagacatgtatgtggggatcattggctccaagtaaaatcgattattgataaatgtcctgatatggtacgcattccgttaaatcgtacaagagaaacagctcttcatcttgcagtaagggaaggcaggggaggaattgtgaatgagttggttaagcgtatgaggccagaagacatgctaataccaaactcagatggaaacacagctcttcatctagcactaataaatcaaggcagccttgatattgtgaatgaattggttaagcatatgagaccaaaagacatgctaataccaaactcatatggaaacacagctcttcatctagcagtaataaatcaaggcagccttgatattgtgaatgagttggctaagcgtacaaggccagaagacatgataataccaaactcatatggaaacacagctcttcatctagcagtaacatgtaaagccaaccttgatattgtgaatgagttggttaaccgtatgaggccagaagacgtgccaatacaaaactcagatggaaacacagctcttcatctagcagtaataaatcaacgcagccttgatattgtgaatgaattggttaagcatatgaggccaaaagacatgctaatacgaaactcatatggaaacacagctcttcatctagcagtaataaatcaaggcagccttgatattgtgaatgagttggttaagcatataacgccagaagacatgctattaccaaactcaattggagacacagctcttcatctagcagtaagtgaaggcaggggtgaaattgtgaatgagttggttaagcgtatgaggccagaagacatgctaataccaaactcaattggagacacagctcttcatctagcagtaacaagtaaaggcagccttgatattgtgaatgaattgattaagcatatgaggccagaagacgtgccaatacgaaactcatatggaaatacagctcttcatatagcagtaataaatcaaggcagccttgaaattgtgagagagttggttaagcgtatgaggccagaagacatgctaataccaaactcatttggagagacagttcttcatcaagcagtaacaagtaaaagagaacttgatattgtgaatgaattggttaagcatatgaggccagaagacgtgccaatacgaaactcatatggaaacacagctcttcatctggcaataacaaatcaaggcagctttgatattgtgaatgagttggttaagcgtatgaggccagaagacatgccaataccaaactcaattggagacacagctcttcatgtagcagtaacaagtaaaggcagcgttgatattgtgaaagagttggttaagcgtatgaggccacaagacatgctaatacgaaactcatatggaaatacagctcttgatctagcactaataagtcacggcagccttgatattgtgaatgagttggttaagcgtataaggccagaagacatgttaataccaaacccatatggaaacacagctcttcatctagcactaataaatcaacgcagccttgatattgtgaatgagttggttaagcatatgaggccacaagacatgctaatacgaaactcatatggaaatacagctcttcatctagcagtaataaatcaaggcagccttgaaattgtgaaagagttggttaagcgtatgaggccagaagacatgctaataccaaactcagatgggatgcttccagttcacttggctgcttcatatggtcgtcccaaagaaatggtgtacattttgtcctctaaggaagtgcttgacaaaatgaatttcaagtatattgaacgactgtttatgatgatcattaagatcgacatgtttggtaagtgtaaaactaattaaacaaccttatttctcctttttgtaatctagttctcttttacatattatgatgttttacaagctgaatcgaatccattgaacgatcagataccatgtgatatatatatatatatatatatatatatatatatatatatgagatgggatccttttacaccggtgtaagaattgatagttttgcaccaataggaatgtaatcaaatagtctaattttcacatattttagaagtacatataccgttaatttatatatatatcaattaggtttcaaatgatttcggattaatatgaaatttgagacatgtgatctacatgatataagctttcaatttaacggtggattttgtaaaatacttatccaataaaaagttattaaatggtgtaaaactatcaattcttacaccggtgtaaaagaatcccatctctctctatatatatgtataatgtttacaattccaacgtcattcgataatatcgaccataattcaataacaaatttaatgagtatcagttgaaataattatttatgactactaggtttttgaaagactgtgatatcatcctttaaaaccaaacaggtcttagctaaattctcattgatttcatatctataaaaggagatatatatgaactcgtatgtggcttttcaatttagttggagtttttatttaccttgccttgtactatttaatttgtgcatataacagatttagcatggcgattatttgaaaaatatccaactgatctggccattgcaagaaatgaagaggacgttacagcagtgaagatgctggagggaaagcctagcggaatgttaggtaacctttcacaagttgaaaatggctttttttttttttttgtgatctaagctaaaatttagatcttatttgacatcatttccattttgattttgattttagaaagttatatatatttttgttctatataaaaaattaagaattagtccttaattatctatatcgagtgtaataatggtatttgatgtttgttgagttattcgaataacacattaatgtttgccaatgaatcagacagtcggctatatacaaaagtattgactcaagttgaagcattggaacagaaacgtgaagatgcaataaaatcaggagatgatggggctgtgaagaggcttattaacaataataatagattagtgccttatagggaccgcagaaatggatggaacctactgcacttggttgtgctatgtcgacaagaaacaatatttaatattataccattgggattaaaagagcaatcagtacaagcagtggactacggaggtaacaacattctacacttggctgcgcgtcttccacaaggtgaattcgaagaattgtccagtttaagagcaagcattcaaatgcaaagagatatcaaatggttcaaggtcaattaatttgctgagtttttcttattcaaacattctttattcactcgcatgggatcgatcagttctagcaatcttattttaaaaatttaaaattctactaattttaggattttgttaactagactgattttaaatctttaaaagtaacaagttttaattaaaaatagaaatcattgtatgtagtatttgttgatattgtaacaattttttttgaaaaattacactagcattctttatacgtttgaaatcattacaataacatcccctcaaaccttactctaatacctcaggaaattgtgtaattacactagatcttgggaggtgttgctgtaatttgttctagttattaagtgatagttgaaagattaattaagttatgcatttggataccatcatttacatattctcttgatttgtatatagtttgtggagtcgaatgttcctggtgaactaaaaataatgagaaacaaagcgggcatgagaccaattgatatattttctgaagaacacaagaagttatccgaagaaattaaggatgcagccaaaggaatggccgaatctggcatgcttgtgtcaacacttgttgctaccgtagcatttgcggctgctctgactgttccaggtgataagaccaatgcgtggtttactgtcttcatattgacaaatgcagtcgcattattcacttcttctgcctctttactctcattcttgtcaaatttcacttcatcaagattcgcacgaagccaatttgtgaaatcactacatcccagcttgactattgggcgttggttgcttattatctccgttgctgctatggttgtggctttcactgcagcctcctttttgatatttaatcacacttccaagtgggtttcttatgcagtggcttcaatggggctgttcccaatacttttgtttcttctttttcattttagctttctcgacgaactctggtggtctagatgttatcgttttgaaaaactggactaacttattacagagttacagagacattggcataacttcaagacactgtattattatttgtttgtggaacaatcaagcttgtgtttaaatttgagattattctacattttctatctcatgaaatattacctttcttattgttccagctttaatttgagactatactacacaacgcacgtcaaagcttttctccttccttctatgtggttggtgaagggatcaaatcttaacacagaaaaagctttttttattacacattcatctttcactgagacttaatcctactccatttgaaaataattactatatacaagaaatttataaataaatataaaattaaaatgaagagaaataaagagataaaaaaaatattcttgattaaatgtgttagaaaatgagaaatgaaattatgagtcctaaccaaaccatatttctcactaagagacgtgaaatggagggagaaatggttagcagtgttcttttacttttacttatgtttaaattttaaaaaatcaaataattgttttataataaaatatttttatgttgagaaataatgaaataaaaagttcagttttttcaaattaaattttattttttatttgtatgaacatttttgcaatgaagatatttttgttttatactctcttatttatttaaacaactaaaaatttacgtttttttcttgttatttctattcatgtcaataatacattattttcatcgtattttgtgtatatttcttgagcaaagttatgtattgagagtgtaaaatatttatatcatcatttaatcacaatttattgtgtataataaatttgttgatttttaaaataataatttatgattaaatgataatttgtaaaatcctaaaattgttttatattattagtgcatatacattaaatttttatttctatccctcttattttcatcttattagtgcaaatcatgttgtcggatcagtgggtttgatcctcagatttgctctcaaattgtactagagaggacacgtcatgtgatacaataacagacttacatacacaacacaatgccacaatcaaagctaaaacaaaatcaaaatccctaagtttaaggatctgaatgtagtgcctactataacctatattagaatttctcaaataacaataccgtggctatttctaattggaacaatcaatatctccactttatcctaaaataaagtttgtaaggactaaagttttcaatgtcctgtccctcctaatcttcctaacgactaaggatttgtctaatactactactctaattctcaattagaactttataaaccaaaacaggttcatctacatttcttatcataatcctcttcatcttcatcttcatcaatccttccatttaagttaattagctagttgaatgggatcaatcttcattttttccatatcagacaaggaccattcagggtattcctcatgcttctcttctgacattgatacccccttccgctgccactgcaacgttcaggctctgtgtaaatcatgaaaaaaaaaaaacatttcattattcagataatatttaacatcaagctgctgcgaggttctttagaatgttgcatctctcagctagaatttccaccttatgtgctagtgctgattctatagtgcatagtttgctcaattacaatcacagttttcaccaaaagttttaagaaaacagatagttttggttctttgtataataaggtttacagactattaaatgtacttgaatttgaaggattccatagaatatgagaaaacgtattggacccagtacatatgaatgttataagatcattcttgttttgtctttgataagtcctctcttagcctcatcaataaactacgaatgataaatgttattcgggtagatgctgacaactcatatttttctagagcaaacatgattattatataggagattaagaaatttaaacctaagtttcttgaacccttactatacatttaagcctaataacttttgtataaagaacattcccaactgtattcgcaagtcagtgaagcaacttgtgaatttccctaatgactgaagtaaattcttttgtaaccagcaaaagattcacagtctgcatagacaagagataattactcagcagaaggtttaatcacacaagaaaaatttaagctaactactgagaagtaattgatatattaccttgttatttctcttgggctcctcgtggctgtcagtatcatcatctttcctaatataaaataaacaaaattcaccacacagaaagcatgttccaagtaaaatgagtactaatcagagcacaaacctcctagaaacagtatggtcatcacgagttgcaacagaaccgcctaaatcagaaaccctgctgacaatatctcttagaaaatcaaagacattaaaagtctgcactcactgttttctgcaaaggcaaggatgcaagtaactcagacatttcagaaaccagaaagtgaaggtaaacaccagaacaaacaacatatgttccaaaagcaagaccatcccaacatttaattttcttctgtagatgtcatttacacgtataatcatgtttgtgcatgtgaaaaatagaagacaaaagagggaaatttaatgagactcagcacattatcattagaattttcagatccaatcgttctaggctgataccaaactaagatgggatgcttccagttcgcttggctgttttatatggccacaacaaaatggtgcaaattttgtcctctcagaatctgcttcacaaaatggtttataaggatattcaacgactatgcttgttgctagacatgaaagaggaccacagcaatgaaggtgctcgagcgggtctggaattgtttaaaaaactatgggctcaagttaatttgagactatactgccttttccgaaaactgcatatcttacgtcaaagctttgcagcttctttccctgtggttggtgaagggagcaagtatatgtcacaaccactgttattatgttaagaaccatttagatcgacattttaataagaaattatagttattccaaactttgagattgagccccagttattctgtgtttcctaggacttatccatattaaatataaacttcagatatctccaatcagggacggaggcatgtggatctagagctaggatcaagttaactgtactttggaattttagtttcacgtctttcttattagtattagtattgcaagtagattcaaaaccataagaacattctttatgttccaccttagataacgttcacctcatgttcacctcatggtaggcaatgcaagtcccacattgggtagttaattatacaaataattctttataattgtctgacatgtgtactaattggcccaactcccgcttgtaactcaagtgatgttctttgataagtacgcttaaatttatttggtgaaaaaaatatttattttgataaaataaataattttctattttttagtgtagttgtctaaattgtgtttatgcttaaaaaacagttttctacttattttgatcaacattatttgtttattaaataagtgcttatttaaaaaatatttattttaaaattacttattttaaatttaaacaaactagtttgaggcgagattagttttaaagagcagcaattagtggtgcttatatattaaaaatcaaataagtatattctataataaaaaataataatatcatgttagaaaaataatggaaataattataaatgtagtgcctaccataagcaatgcctacatgagattaaaatttctcataagtcataactatactggcaaatggctatttctaattggaacaatctatatctccacttttaacctaaaacataagttataaggagagtattcaataccctatccctcctaatcttcctaaactactaaggagtaagtatctatctactgctcctataaaatctacactctaattccacataagaacattctaatgacgggcctgtatgagaagtaatgaatcaaccaacacaggttcatctacatttcttcatcataatcctcttcatcttcatcatccttccatttatgttggctagttgaatgggatcaatggtcattttttccatttcagacaaggaccatccagggtattcctcaggcttctcttctgacactgattttgcagatgaactagttgggacagaagttggtgtgtctaatgaatccatatccaaatctggttccaaatttaagtcaaaatttcgaatggacacttcagccggtttgcttactggaaaactctgcttaacttcttcaggttctggcacattttccatgctttcattgctttgagtttcattctgcttcaatgcatcagaatcatcttcacacttagcatgtgaactcatcttttgatctacagttctaattccacggccacaacccctacccggctctggctgtgcaaatcatgaaaaaaaaaaaaaaaaaaaaagttccataattcagataatatttaatattaaacagctgccaggttctttagtgccaattctatagttttcagcaaaagttttcagaaaaccagacagttttggtcctatgtgtagtaagctttaagttgaagtggggcctagcctcacagacttagacatttagacgtacttgcattcacaagccactagtgagtttccctattgactgaagtaaatttttttgtatccagcaaaaggttcccagtgtgcatggacaatagataattactcagcaaaaggtttaatcacacaagaaaaatttaagctaaccactgatgaagtaattgaatacagttgataaattaccttcttttttctcttgagctcctcgtcgctgtcattatcatcatctccggcaactttcctaatataaagtaaacaaagttcagcatacagaaaacttgttccaagtaacaagagtattaactagagcacaaacctcttcttagtgacagcatggtcatcgtcagttgcaacagaacagcctaaatcaggaaccttgctgacaatatctttcagaaaatcaaagacattaaaagtctgcacacactgttttctgcaaaggcaaggatgcaagtaactcagacattttagaaactggaaagtgaaggtaaatactagaacaaacagcacatgttccaaaagcaagaccgaccatcccaacatttgcttctgcagatgtcatttacatgtctaatcatgtttgtgcatgtgataaatagaaggaacaagagggaaattgtttgataccgagcacattatcattagaattgcagatctgatgttcttataagtacatagtaataaccgccctccaaaagaaagaaacctgcagccttgtgaccaccttgaacagacttgacatagacacaaatttgaaccaagaaaataatagaaacttcacttacaaatgaaaagcattcatagtctttgcccccctcctcaaagttatgttcgatcacacaaatcttgcagaaatagctctagtgctttagctgcaatacataaacacaaataatcataaatcagagataattcatagaaactcccaaaaccacaataaaaaaataaaataaaaaatcatttttcaagagaagaagaaaacacccaagaatatgcatgaaagagaaaggctacttacaaactagaagaggcacagccattgcaatcttccctacatcctcgtcagcttgcataattttcttaatcctagcctgccaataatcaattcaataagattactcaatcattacttaaaatgtctaaaactaaatcatgttggcagaagaggattctaatttgatgcaattaaggaaattccactgcaataaatgaagaaagaaataaattttcaactaaaagttaaaggaaaagactgagtgtttgtcctactccaccagaagtaatctatgctcaaattccactactcactctcctcctaaaaataaaagtataaaagatatgcgtgtattgtgcaaggctgtggagacagaaaggtatattgtctatattcaaacaatcaaatacatgtacaatggggtcaaaagtgtaagaatacaaggtgtgcgacagaagacccttgtgtctatttcccacatgaacaaggcttaggtatgtgtggagaaaaactatagaatctgaataaagtacaacagatgatgggtagtcccatagttagagatagagagagaccaacaaaaactatatttgtatttaaatgattaacctatggacatgatttataataggacatgatggcattgtttggtccatatattccagcccacctagtgggaaaggagtttttgttgttgtattattctgtttgagcacgtgtgatatgctatccaccaggatcatagtatggaaatacttggaagcagtagttttaacaaaggaataaacaatcccttctcagaagatcaaagaataaaatccagaattggaagtaattttgcaaaccaaatggcttacaaataaatttgctcaactttacatctatctaaagtataaaaaaaaaccacatacttcatttcccagaggctctttgctatgcgaagatatgggggaaggatattgtacgcaaccttaccctttcatatgcaaagagacttttccggatttgaactcatgaccaacaaagtcaccaaggctcaactttaccgttgtgtcaggattcgtcctcatctatctaaagtatcatttctaaaatatatctacaggacaggtagtggccaacctacaccgcaaaaaataccattgtttgagagggaccaaattcagggaatttttagaaaagatacaaaataccaaatttagaaaaagttagaaggggaatatatcacaccataccacagtactacacacaacatgctgtcctagctttacaatacacaaagcctgacctaaagcaatgccaaaccacctataatgttttacattccaaaatcggtaattgatattccacagccaaaccaaagcatgcggatgctttacaagacaactactatttccaaactacgtagacataaaaacgaaaaacgaaattataccaacaaaatcgccaagttaagacatacacataataaaaaaagatttaagatatgcgccaatcacaacttcaaaacatttgtttcctttctgattaaatatgttgcactacattaaaattcaacagcaggctccccatccttctttctctttcagaaagaaaacttatttcatccaaattaacaacattctatggggcctataacaatattgaccagaaaaacattaactttaacatctaattcattaacaaagtcaacaattcatggcaaaaaaatttaacgcaacaacaattccaaagcctcaaatgttaatacaaagcacgtttgcacaaacataactatcagagattccaaaaccaagagaaacccatctcccatgttagtcagaaacatcaatttacacaaggaaaacaaaaaacaacaaacccaatgacacaaaaaaatagcaaacataaacaactcacaatgaatagaatgcaaaacaacaaggaacaatattttctacatgaaaaaagaaaacaaaagcaaagggaaagagaaattttaccgcagggaaacgagtatctagattcttcctcatgttgtgaaaaaaaaaaaaaaaaaaacggttggagaagaaggcgaaaccccactttggtttttataaaggggaagaaaacaagattaacgttgaagaagacgaagaagcaaagtgggaaagttttaatttgtattttgtcgtgtgtttgaagtgcgtccttcccctatcacgaaagcgctcatttaggagcctccaagtccaactatgcacactttgtgtttccaaacgtttcaaaccgctaacttcttttctagaccaaagccaaaaccgaatttaaatatagatgatgagttattattcattatttcattcattcatactacaaatctacagtcatattataataatatttttattttttatcacaattttttgttaaacatgatattaatataaaatagtctcatcttcgtcaagatgaatcataatcatacataagataaatttttttccaatactatttatttcatgagttaaccaaaattcaaacataaaccaattaggacaagatattatttattatatttttatatatttatctttttcttagttatctttggtataataagaatgaaaattttaaacactttctattttagttttaatttttatttatttaataaattgtgttaaatagtttgacattataaattagtcagtaccatttattaaaaagtgagttatgatatatactttataaattactatgtgtaattaatgagtacttaaatttatacattaatttattaattattatgtgttttttattataattataattttattttttaaaataacaatatcaaatataaaaattaaaaaagaaagacaaaatatattttggattcctataaaatttgaaaaacattaatttaattttatattacataactaataaatttaattattttctctttaccttcctaagcatttaccttcctaagcatatgcagaatacattataatctattgttgtttgatcttcccccttaatctcactataaagtgaaaaaaaaaaatagcataggaaatgacaaaaattacaattttgaggttttagctgcaatttttttaattcattttgagggttttaattattacaaattttttaatttgtttgtaataatcaaattatgtgtataaatttattagccatgtcaaattattgtctaacagaattatcatttaggaccatcaaaaatatatttattgttacatgatccaagttaatgcaaaaaaaaattatgagaactaaattaatactttttaattttataggactccaaacatattttaaaaaataataataaagatatcaatctgcaattgttagttcattttgtatggtgtacaagtttaataatatttcaaaattattaatatataattatcaccaatattataatatatatatataataaattatatgccttccatgataatattttttattattatacctaataaaattatatgaaaaaaatttatataatcatgaacctatctatctatatatatatatatctatatatatatatatattataaaagaagattttatataattagaagttaattatcactcacacactttagctcatttttaattaaattaattctaattaattaattaaataaaatcaattctaaatctatatttatatctatatcaattaatatattatataaaataagattgtcaattgtgctcagcatatataacaagtatcgatgtagttagatgctgcataattaatttatcttttttgtttaaacaaacaaaataaataaagaaaaacaaaatcatcatgaatcaaaattacaatcacatttaagttttttcattaaaatctatcaaacctaaattaagctacagttcatgaaaagtataatgtaggagaacatcaatcaaaattattattggattgatatcaatccattgaaaggatagttttttaaaatattaaatataaaaggaaatttaattttaccaagctaaaactttaatataatagaaaaaaaattatcataaatgcattgttggtttttttggataattttatgtgatttttaattgttatatattttcatatttaaatatgtttctgaaaatatttaaaaactgaactaggcacaatatttcaaatcaccgtttgcttctatattcttcaaaaatctgaacgccctttcttctccataaaaaatgctttcaaatactcttatttttctacattagtttgtgcaatctttctttatatatgtcttcttcgctcttaatattcacaagtttatgttatttctatttcataaaatatgtttgaatcaatacatgaagaagaaaaaatgtgagcaatccgtccttttcatctttctattgtcatttattttatcttattaaaatttatgtttttatttgtattaatgttgtcgtttactccttaaaaactgtaattttgataatttttttgccaaataatatttacattttttttttcttatgataaaagtatgttctttacttttatgtctttttgtttgttcgtataaaaaattctttacttttactatgtggacttttttttttacatttttgttagtgtataaaaaaaattaaatacaacgtgcttgattcactaaataaaggtatgttctctacttttatgtattttttatttttattttgtgtatacaaaaatttcactttccactctttttttcatttttgtaattgtataaaaaaaacatatgatgtaacatatatgattaaccaaataaagctatgtttttttttttgtttttacttcttatgcctctaattttgtttttgcgtatatccaatatatatacaataatagaatcttatatgtgtagtctaaggcaaaataattttgaataggaaaaagttgctcctgtttttttttattgcaaattggctcagtttgaaacttttgaattcggtaaatttgcacatagctcttagttagtttaatttccttaaaagtcaatatataaatactactaatactaaagtctatttagatacaggttttctttattaaaaaaaaagttttatatttttaataaaaaattcttaaaaacatttatagattgattaattttcttatatgaacaattaaaattaactattttactctataagttaattttttttataaaaattaatgtcgttgtttttatcttttataagatttctgtttcttcaaaaccctaattctgccaaattcagtttgagcctcgaaaaacctatctctctttttctctatctttgttctctctctctctctctctccaacgatttcggcattcaacagcgatccttccgtcgccatcatcgtcatcaacgctcccatttccgaaaccccaggttggttcttcttcgtgttcccatttttcgatttttctctctctttctttcaatctcaaacagcagctatggtcctctctcgcggaattcggtaattcgcctctttgttgttgtgttggggactaagaaactgcgtgtttggtttcgcgttttgtgcaatcgcagaattcggtaattcgaattccgcatttttgccttttgtggtatttggggatttcgggtctctttggattggggaagcatgcatatcacggatcctcgagagggaatagtgtgctgatccttgtaattttgaccttgattgcgtttatatatatatatatatataattttgaataggatgtgtgtgattatagattttttgtatcgagtggccattggggaatattttttttgccagaaagtggaattttttggatgtttggatagacatatcacatatcagtgttatgggggattgtggggtcatggttggttcacaagaatttggatttttgttaggggtggggtgatcgtgtgaaaatttgggggagtcatcaatcatgtcacggcctttgaggaatacgaaaatcaacttcctttttttttttcttttatttactgtgttgattaatgtataagtggaatggtggaggactggagaacatggaatggtgttttatttttgtcttacggttgattgtttgaaaatatcggcgccattgaatcgctgaacttctgtgaaaggtgatactggactgtatgatacttgcactctcaattgtctttttaataagtgttgtgcattcttctggtaaattcaactgaaatattctcaattttgatactgtgccattccgagagggatcttgctttttgctgtcagattggttgttaaattatataaatttctggttgcgcacatataaatgaagtttagacatcattggtaaaaaagttcctctgtgattaaattctctttttaaaatgtattaaagtgtatggacatgaaatccttcccctcttcctatattcctcaatgatttttattaaaacttctttatagggggaagataaactgtatggtttttgtttaattattttaacatgtacttgttttttggcttgttcactttctttttgcctttgttcatttgcgcccccccccccccccctttctcttttccctccctcccacagtgtctattgttatactttaaactagggaatggaagttagttttcattctcattagtttttttgcaagtttcccccaacttgtaagctgttgcttgtttgccaaaggatctgtacaaacatgatggtcctcatttgaacagatttgtttttttttttgtgtgggggggggggggttgtggcgattgaacagaatattatttggtcaataggtttgtgatgcatgtaatcctgtattgatttggtaattaaaatgcaatgtactataacttgttttcttttaatgttacagggccattgactcttaaggatgtctcctgcatcccgatccaagtctaaagacaggaagcctagcaaggaagctcagaaggcttctgcaaagcctacaggatctggtattgcagcagctggtgtgccagccagtgcatataaccccttattaggaacattccatactctggacatgtcaccaacacctacctcaccaatacattcgaatggtcgttttcagaacatagatgagacagatgaacatcctgtcagctcagtggttgctggtgttgagtatgattctgtttctaacaatggtagttggtctggtgagtccgaagaacataaggagaaaagttctaatgttgctgttcgaccggaatcagtaccaggagctgataatgacaagcgagagaaaatccgccagaagaatgagagaaaacatcaacggcagaaggaaaggcgagcacaggagttgcatgagaggtgtactggttatcttatgttaaggaaacttgaggcactttctcaacagcttgtggcaatgggattttctcatgaaagggcaacaatggcactgatattaaatgaaggtagggtggaggaatcagtagcgtggttgtttgaaggtggtgaagatgcagatgttaagaaggatacaaacataaataggggcaatttgaaaattgacatatcaggtgagcttgctcggattgcagatatggtaaccaggtatgattgctcaaaacaggaggtcgaaagagcgattgttaactgtgagggtgatcttgatagggctgcaaagaccttgagagacttgaaacttgatccaccatctgctccaccaaaaccagaggaaaccggcgatcctcctattattaacaatgttaagcagtcaagagttgcaagtcagagctcaatgccacaaataaaacctgttcctttaccaaatcaacccaaaaaagatgacaaggattttaactatacaaaggctgcattgacgattggagtatcttcagattctagtaatagaaatatgcaacctctaaagaaaatccaacctaagtctgaatgggcaaagccccaacaggctactataccagctgataaaaggtggccaagtgcaggatctaatccttccgtttcttattcactggcatcaccgttgcaaatgtcacccccacctgcgaagtccgaagcacaatatatgcctgctggaggtgattttaagaaccttcaacatggagtagccagggaaccattaatcatgatgcagcggccccagactgtaaatgcaaagcaagttccagccacaagcatgagctcatcacctcctgaaattgatgctagttggtatccatctaacagttcagatgctgtcagatctaataatgactttatatctcatgctcgtagcactagaagcctcagtccaaactatctcaattccaatcaaatgtaccaccaacttcagtatcaacctcaacaacaacagtttgttggtggcagcagcaattcagtagatcaccaagggaatagcatttggaatagaacaggtgcaattccaccgcttgctgctgctacatctctaggactcttttccggtctaggatcagcaggcccatcaggggcttcttctccagtagactggagcactggtgggaccatgcagtttgattataccaacatagactggtccttggacagaagtttagcttcaccaaggtccaacggtttatggctaggattttcaccgttttcaaggagcagtagtgctcagatgtatgactcaaatgcttcaggagttgttgctgaatcatcaatgagaccagtgccctcaaatgggagcatgaatgctcccatgcctggattgcaagatggtggagtagcttctgctgagacatctgctgctggttccccggggtggaattctccttttgaagggaatgatctttttagtttaccgagacagtttgtttcttctccttctctgtaaaatgaggggagaaagttgaatgaataaaatgaaagacatcagaatatgtttgatttgatgttggttcttatgattctacaggtgattgttggtggtaagctttcagtgggtggaacatgcaaattatacattctaagttctaacccgccactcatcacacaaaacacaaaatatgccgcaaatttatatttatatttatattagtagaacttatgggtttaacgcgttaatgaacaacttgcgttgaataataaataaagtgtaagaataaggaatgggtaattaatttctgaagtggataccgatttaagctaaccaagtttaaataaacccgtgtttaagggatctagttcaagttattgctcactttggattcatatataaaaaaaattaaacttgtatgttgaatttaaatataaataaatttaattaattttatcttatttaatattattatttaaaaatatctttcatttgattttaatttcttaatgatttttatttatttatgataacaaattttaatgaataatgatattttagaaataattttatttttaatttgagattaaaaaaattaaatcatgtcaactcagtaaaaattaatgagtcacccaaggaaggttgaattaaatgcagtgaatatcatcgttgacaattggttaagtgcttcggttatccaaattatacatcgtggttaatggacgaaattgcgtcggcacgaattacatgcagtttgaactttgaacagacttttaacggaagcatggtttttacttgtgacgaaatcccatttctcccactgtccaaattctactgaccccactcaaatagtttttttaatcgaaatggatccacttaaaccttttcaatggtcattttttaatgcattacgagcaagaagagagaccataactatgaatatgatacacaatgttcttctgtacaatacgagtgtgtggacgatattgatatattatttccacaacttgtcaaacacaggatgtctaaccactatcttaatccgtgcacattttaattttgtgaggaaaatttggtttgatattgttttgttatttaggaattttatcttattggaattagaatatttaacttataaacttgtagcttatcaatataatatttaaatatatatactttttagcttctaaaattttattttctattttggttcttataattttttattcattttagtgtctgtccgtttataattatcatcatctgtcagtatattctttttttccttctgttaatactggttgcaggcaccaagttgcgccattttttgctctttatattttttttcttctactaccaatgttttgtgtttctgcctgatctgcatgtgagtgttcccacgggagcgtatgttaatttttttaatttaacatgggtactgtcactttgaataacttttaaatggtttttgcttccttccaactgggttagctggctcttgtaaagttgttttatttgtaacatgcatgtaaataactagatatatattgcaatcttatatggtataatatgaacctgtttatggaaaccattttgtgtattacaacattaaatatatgagtatcatgttagttactagatttcaacaatgtttatcacagatcactcttcatggaaatactaagacatgtcctttattagatttttcattttctttcttatctttcgattaaaagctaatactgaaatttgatacaatcaacttatgatttactgtgagttgtacctttttgtattcagcttcaccaaacaagtatattgcacagttgaaatgctaggaattggcactattctacttctttgtaaattttgattatgaaatgaaatccaagtcttctacttctttattgtttcatcatgttgattttcagtgcttgatctcccaataggcctctgctatacacgctgacttcaccacttatactctcattgttggtcccagaaataattttgaaggccctggactttgctgaacgtatggaggtatagctaatatgtatagccttgcatgtttgcatgtgttgattgctcatttttttcatgatcatgttatgttaatctttaatacaacaaacatatgcaagtcatagttgtttcttgaaaagtagttttaagttttgacatagcaagtttttgtcattgacaatgttgtaactttttgaagttgtttctgcttcaatgtcctggtctgataggaactcaaattcatcttcattggtgaagccacctcaattaattagttccaggagggaggataaccttttactactgcttggatgttcaagaagcctagttccttctgaattaattgagagattgcatcacctttgaaaaagtcatacggctattttttttccacattttatgtttctgttctcagttattattgaatttaaggctttatttagataaatttagtagaagaaaaaaataataaaaataaaataaactttttttataagataaaattaatttatgtataagttagaatcaacttatttagaatcatttaaattctctaaaaatgttgattttatcttatacatatgcttgttttagcttgcttgagatacacttatttcatttttatgaagaaacttatgcaaacagaccttagtatattttattatgcaaaggggaaactttgaagacaaaggtcgtgtacatgttattcattttgttcctttagaccttcaaactacgttcattgaatcattcacttttaccttatcttgtaagcaccaacaagtgggattaaaatcttaccgtcactccctagctacttttagttccattctttggatcgtttcactatcaaaatcatttggattttggtctgaaattccaccccaatatggatgcaataacttgtggtagtgagcctgagctgccaaattgattagagatcaaacacacaatcacaactcaaagtgaagaagaataacaacaataaataaagacacaaattaatgtgacaaaatatcttggtttttctttatgcacttgcggctagctaggtgttggcttccaatgataactactcataaagtttagaccaagttggcagcatcacagttggctctcttttgtttgctaggtgaatcctttaactttttttttcctctctaatttccttattataaaagaatacaagggttgtgtagagtagagcatgtgaagtgtccattttgcctccaataattttccacagccaaaagtactacaaatatcccaataatctcatatgataaaaagtagtgtggtttgattggatcctgcatgtccttcctctgttaagtctgccccagcttcattgtatagcaatatatgagagtagccaaatctaacggttgacattgacacaattaaccagtgatatgagaatatctactttattgaatggctagctagttgcagaaaataatgtgtgaaaacacatctaaggaagagagaatattaaaagggcatattcaaattatatattctaatttataacatgaaaataatcttttgtgaattcatttgaaattaacatgaaaataaatgaagaaaacgtggatcggagagtaattatttcttttgtcatctcaaagtccaaccttctttcccaaatatcaataggaaaatttaaaagtagccagtgattttaaaactcaattagtagcgatccaacttgttaacatgcgtattgcgctgtgtgtggaaaatttatcatttacctggttactcatcagtttaatgtgtctataagttcatataataaataacgtaataaaaagaaaagtataatttgtccattaccctactttttttttattttttactacttttcatctataaaaaaaaaactattttcccgtagggttaaggggttttgaggacaacaataccccgggagtgcgacatcaaatgcaaaaaagtgattatattttgaaaatcaaaatttttaaacactcaattaaaaaatcatttttttatctttctttttattataatatctcatcaattaaattaatcatttatctctcatttatctctctctcaagttatagataacttaagattgtccaaaaactatttttcaatgcaaaaataaccattgatatataaaaaaagacaaatatcaatcaatattcttacaacactgactaaataactaaaaaaaggatttttttattgaaatataatatatacatgtagtacctcttgatatgcgacccttcatgttgtttgtattttttgtgacagatatacaaacctttggtgccagagaattatgttgcttgtgactcctaggcttggtaattaatgcatgcatgccaacagggtcccaccttttgtttttctgtgtacatgacaaaatcacaaaagcacgatcatgacaaagatacggggttattaacactttaatttcgtttagaaagataattattcatactctccaaatgagtatatttataaaaaataaacttgagaaaaattattattatttaataaaataaaatatcttcagataaataagttaaattttgaaaataatgtagtgtttcaatagttcaacttgtattgtttactagctcatagtgacacttcatatgatttggaaataaacttgaacactcatctatttatctacattttcttttagttgactataaccttaattacccaaaatatcttttgttaacttatatttatgttgaatattttttttgttaattatatttgattttttcaaaattaatttttttttgttatcaacacaaataaaaatcacaatccatcatgttattgttatgtaaactaaaaacaagaaatgaatgatcttctctcttcttgcttttctttattttatttttaaaattatatttaatgtttcataaaagataaattttctcaagtttaagttttgtaatgtcaattaaatacttttggattcttattattttattttatttttaaattttaaatttgatatatgatgtataaagaaagttaactacaataattttaacttttatctaaaagaaaaagtcaaataaagtaagttaaaaataaaaataaataaataaataaataatgaatcattagaagttgccaagttggccctcactatgtgatatgttttcttgtggatcgttaccatttatctatgattatttggacgcaagaaaccacacattcatcttagtctaggactctaggctacattcctagtgttccatatatagactcaatccagtgactatctccgtgtttcattactaaaataaaattccaatacactacatattacatcgtgtaagtcgaagttctcacagcaataagatgtcttaagatgaaactaaatttttacattttcaaaatagataattgtatcaatttacactaatttttccattaatttatgctttgaaactatcagctatcgagggttttgaatctctttatcctgccaacttagacacaaaggatgatagcaaattcttatttaggctgttgatgggtgggttagcaaactaggactttaaaacgtacaacataagtgcttgtgtatttatgactatagccattgtgagacgcattctaatataaattttttgactatgattaatttggatatacatcaaaataatgtcaatggatgcaatgtgcaatctttgaatatgtaaaatcttactttttctcaacttttgtttgagataaaccaaaatgactaacacatgcattgacatgtatacattaaattgttacggcaaaattcctacaaatttcccatagtattttggccataatgcaacccaagttattaaaatgccaagttgttttggcaactcaaccaaagtatttcctaaaggtttccattgctagacctcactaatgagttttgaaagaaccatgctaacaaacagaaagagaattagcttgacaccattctcaagagtgcactccataagcttgatgatgcagttatctcaggaagcaaccttaatctgtgatctggcaattcacattcactggctaaaagattcatctaacaaaccaaattcactctctttagtctttagcatattgtgcttgctgccaagaccccaaaggaaccaaacaaaccaaataagcagcaagatacaatcaaattgaataatgacaggtgtggcactaaagtttcaaagagattcaacaaaccaggcaatttcatgtacaaagattttaagaaacttctatcttccttacatgagctcaagtttaaaatacaatactaataaactctttccttagcattttaaattacaagcattattagacagcaaattgtacttatccaggagaagaaaggatacttttagcgatcaaatggccaaccgctataacttgttccattattctggtcaggagtggttgaagagctgcttcccccagtctcagaataatgattattgttagagttagacgagcggaatggccacaaaaatgataatggatttctccttccatggttctgatggctgttctctctgcccctagggatatcattgctgccactgctgctgctgttgctggcattccttcctccccaacttcgagtaccacgggaactagcctgtccttgaggtggcagctcaacacggcaaacaggacatgagttatgctgaaccaaccaaggaacaatacagtcagaatggtaaatgtggttgcatggcatctctctggcttcagtgcccaattcaaatttttctttacaaactggacagtgtgaatccgagcgaagatgcgcctgtgttatcctaatagtaggcattgcatcaattgaagatcgtgcagctggggctggaccatgctgatcattcatggtgagttgctcaataagttcttccagtccaggacccataaagtagtcaccaaaatcaacacgcctaggaccacctcttgggttgccagcagccaaggtgaatccgggaacttgaccatgaaatattaaataaggaccggaactaaaaacgccccaactctgttcaggaactgggacagaaccagacctccctctaacatcaaagtttgagtttcttccggccattctatgcctcatgaaattatcaacggcatccataagcccgaatctctggtcagaacctctctgccccataaaagcatgtatagcatcaaaaatgtcaggcatttgatgaaagtctcctgactgtgacgaaaaggtatggttatggttgggtgcaattcctcgcaactcatcaagttcttgtacaaatcctccatcacagtaagggcaaacaggatctctcccatcaagcacaattggctgtctgcatgcataacaccagtgtgttgctccacttgacatctttctttttaacaaaatttaatttgtaaaatctgcaccaaaattcaactttcattttttgtcaaatatactcgcacataatcagaaataaaaaagaattaattaatcaaaaaggcatgaagattcaatatgccaattggttatgctagtatcaatatgtatatcctaaacaccaccaacttagtaacacacaggaacaggttatctcaccaaaagtgagcgatggctatgtatatacataaaagcacattaaaccatcctattgcttaaatttggaccaggacaagtcaagagtcaagactaccatgatcagagaagctgttgctacagtgtcatctttggatcaaattatgaaacactagaacaaatttgatgagggaaatgatagcaacccatcctttgacacattttttacaatcaactgaaatttatcgggctcacaaaatgatgctggtctcaccttccatgtaatgactttcactaataatcctgtgaatttcaacaaactttaaccaatagaaattgtgttgcaagcacccttaatttcacaatccgatcacaaagtgcaaatcatcaattgaatgaacccattaaaccagatgctagacatcagtgctaaattacccaacacaacaatttgctcagacaaaaaaccatatatccggccatcaggacagcaaagaacaggtccaacagtaacaatagagggggaaatactctgtatattcatcataataaacaaattgaaatgaaatcaagttttcctaaaaggactatttgttttttttttatcaaaggtgaataaaggaataacaaaattcatgcaagatgcaaagataacttatcatgaatcataacctcggagacagtaacagtagagagaaggcataactaacccccaattgaaaattaagaagaaaacaaagaacttgtcaataaagcacaatttattttcatatggggtttcaatcaatcaatacccatatactccaatggccaaattaagctcgaaatcatacacaatcaaccgcaaaaataaaaataaaaaataaaaaactgaaaaaataaaataaaataattgcatgagagcagaaaggttcaggattcatcatagtgaacttaaaaaatgaaaaagacaaattaaaagcaagaactcggagcttagtaccgtaagattcttagagtgagggaaagagagagagaaagagagaagatgacctttctctgaggtttgttccactgacgaaaaagtctcgttatttttaccacttcagaatttatgactctttcttttatatcataaaataaagtaaaattcgtagtgggagaaaaaaaaaaaacttagtggaatttctaacacaaactatcggcagtttctaaggaataattattaaaacacgccatctttttaccgcgtttgatgcagaaatgcagtcacagaagttaccttcaaactttttgaatggaaactttaacaaaacacggaatagttattaattattatcatgtgtgttgttgggtagtttttgtgttattttgttatgaatttattaccctttttactgctcatatagttttagggatgagttggattttttttttaataagaattaattaaatagcgaatttagaataactcgagaaagtacgaattttctttctaccaaataccccttaaacataatttattttttcactttcgataaagtaaaaagtttctttttatgaaacgtctcctaaatgtatacattgatctagtatttattttagtttctttaattttatgtttttattttaaaaaaaattgaagtaattatatttagttttggttttgtaaaagattttattttaaatttttattcaaaatttgaaatcactatttttaatctttgatattcattttaagacagataaataatacaagaaaaatattatgaactgataatataaaaaaatcaattacaaattattatgtatcgtaagtttattaatcattaaattcaaacaaaatttaagcttaaatatatttttgatttttgtgtaattttgatttctaaaaaaattattgcacattttatcctcatatttttaatttttaacaattttaattcatcgttattctattaaacacataaacaattaatgaatgtagcatattactaacaaaataatacaaatttcaactttttgagatataaaaattaaattaattattttataaggtctaaaatcaaacttaactcattttatagtttataggaaataaaaacatatttaagttaaaatttaaataatacaaaaaataagtttaattttaaaattacaataaaacaaaacaaaataaaattaatactaatatatgcttaagtccatttttaatctctagtattacaaatgtgcaacttttgtgcttataaaaatttaattatatattcgatccttaatattttcaaaattaagcaattttattccaccattagttggtcatccaaaattagatggaaaatcaagatgtgtatgtgattaataaaatgcatgactatcttatttacataggaaataaaataatattaaaattaaaaattaaaaaattgttttatatattttgaaaatttaaaatataattatttgaaaatttatttgaaagaaataatttttaaaatatattaaagcaaattttatattttattttccatattattaattttttaatgtaaataagttaatcacacgtgttatttatcacggtcatattaatatttatcatttaattttgaatgcagattagtggtagattacaattattcaattttgaaaatcgtaaagactaaatgtgtaattaaatttttaatggaactaaaactacacactcacaaatatggaaataaaaaatgaatttaaactatttatttaatataaaataaacagatattacttgctattgccaataatatatcgagttagatcatcaacagctactttgcccatgctacatgttaaaaggcacgtttcctttattcctttttgacataatcgtcttttgaaattacctttttatatattttagtctttaacatttcaatttttttttttactaattcttaacattaaatatttatgtgttaattaagttttttaatataaaataacagtataaaaatttaaaacatatttttgtaaattaaaaaaagaaatttaaaaatcttaatgaacaaaatgcataacactttaatcttaatttttttatataatttctcttagatattctcttttaaaaatattcttatttgagacgcaatttgatatcaaaccttaactgtaggttatatgagactagcacgttccattaaattgaactcccgttagtttgtaatcttaatgattaaaaacgagagtttactcttttctttaaaaatatatattttactgacaattcactaaaatttaactatttttattaaaaatatttaaaaattaatttaaaatttgtgttgccatgtacgagagacagatcatagatgatataagtcaccgataagatcaattatgaatggatccaccaacataggaaggaccatggatatatgtatatactatatagcacgacaaggtgatggtgccctataattgcattagtcccaattgtttaagtttcccaactaactttatgtcacttataaataaatgtgactaaagacttctgatttggacatttgtttgacccgcaattaaagcattttttttatcttaactactttttcaatatgcatttctaaattctaatgttagtagacaaattgtttttaagattttatagatttgaatgaaaaaattgataggtaaaaatattatttttattgggtccatgatcaaatagtgttatgtttcataatacacacttactatgtaaggctacttcgttctgaatcctgatgcatcaagaaaataaaagtttgcgcggtttgttaatagtcgaggcaacttcttgttccaaacaaatgagagcaattatatttagttatcacaggcccccaaatgcaagatagtgctttaggacaatttaatgtcttgcaaagaattataactaatactatattttgatattttcttatttgaagttgagcaattgtttgaaagtagagcttcttactgaatttaattcctattctacatgttacaaaagtattagtcattgtaaagaagaaaaattattgttattaaaaaggaacatattatttttaagaaaaatatttttgactcttaatagtaatacatccactaagttaaataatatatttttatgctgacaaaataataacaattttttgctgaataagaacatcaataaagggtaatttagtcaagtaccattacattttctgaaattatggagggtcgatatcatctttcaccttttcaaacatcaaaattccaattattaaatactaaatcaaataaagttccaatcagaacaaatgaactttacaaaacaaaggtgataatgagaagacacgcaatgaatttggtaaagatcagtgttttgtaactgcagaagttaagtgaatggtaaaagttgaaactaattggctgaattgggtttgaacaggcaaagcaatcgttccattaaatatagtcaaaacaatcgaggctaacatgacaaaaaagttgatggaaattgtatttgaaatatacaaatgatcccttaatttatttagtatttactacaacaatatgtatgatatttcttggaatcaaatcaaaatttgtttgggtattgttgtaatagcggtggtggcaataatgattgttcggtggtgctgatgaagctaaggtcagcaaaattggcgttggtgaaggcatgcactcaaacgatggcatattcttggttggtttcgagaacccctaagcaccaataaatagcttgaaaagaaaatgatataattaatataacaagtcaaaaaccaaactggttttattctatacaccctgaagcacattcaatgaaattgacaggttttgagaaacttatcaaaatttaaatggaagcacatcgttcagttatctgaatcccataaatctaattcaagaaataatattcaaagttacatatcttaacatggatacttaataaatctatatctctttttattctcacaatttttccaacaaaaccaccattgaaaacacagacctaacatgaacgatgaaagaaagagtagcagactgatcagcctcttgaaaatggccaaactcaaaagtcaacaagaaaacttaaattttgttgaatgcaacaatgtcacagctctggatatactcgttgcatggctcaactgtcaagcgttcctcaacgagagtgtccacagatacaaggtcatccacaatagtcatcatgatctgcaacttcttgataccatatcccaccggaaccagtttggctgtaccaattgaaacaaacattttagataaaatataatttggaaagaagttaaatgcatcaaatatgcaagagaaaagtttatgaaaatttcatacatgctccccacaataaaccaggcatctcaatactgcggacaacctcttccagcttcttcatgtcggtctcatcgtcccaaggcttaacatcaagaaggacagaagacttgccacctataaatgtcaattaagtcatagtgtcaaacgctttcaacaaaaaaatatgatctagcgataagaaaatagtccacgtgagtgtatgaccagtcatcgtaaatttcaacctattactctaccatataacaagacattcctactttccccaaataactatgcaattttaggtggattagacaaattcatttatggcttctatcaatattatatttctgggaattgagaaatgtttcatggaccacaaattacaatttacagtcaggagactttaaagaaagcgtactctcttttttcttggcaggcttcttagcagcctccctttcctctgctgccttcttatcctcctctgtctcatcaccaaagagatcaagatcatcatcatcttcttcagcagtggcagcctgacaaattcaaacaaatcccaatgatcaaattagttgaattagttcacttagcagcttcagtacaaccacaataatatcttacacttcacaataagtatatctgtacactataaagtcaaaagtctatttatataattttacaatacaagtacttccattcatttcaatattattatcttagataacaacaatttcacttagtaatcacatcatgatgaattcaatcaaaactactactactctgcatgggatataaaacttaagtaactatctcaagtcaaaagcaaattatagtgttattcaactctaaaatgtgccttcgatgttgtaatcttggctaatacttatcgtgttcaggaactatatagtaaacattttatgttacatatgaatatggttacataatcaagctctgttctttctaaaactatcaaagtacttagtgttaggtgttcgcccaaatggattaattgatttcaaattcacatcttataaaagaaacagatgctaaatgagtaaattatggaagcatttttctgaaaagaaaataacactctaattgctttgtcttctatttcaactgcaaatctaaggttttaacttttcacttaattatgtaaacatgttttctctttttgtcagagtgatagttttaaatttagcatgttacaggatcaaaatattgaaagataaaaataagaggtgtgatgcagtttataatttttaaggcatactatgaaatttttataattttttaataccagttcatccagtcattggttcaatcagtgatcaagtgccctgaactagtctagtgggatcatgactgggactgattgcataaaatttaaatgcagaaaatccagatcaaaaatcacacacacacacacacatatagaaagagagagacaatggttgtcagcatcctccatttcttttagaccaagattagtcatgatcctgcagctcaagtttctttaatttatatttcatttatgaagtttgaaaaacaaaatagccagtaaagattctactttcacacactgattgcaggcaatctccaattcctatctcttacatgaactaactggaaccaaattgcctgcagtcagaacagtcactgcaagtgcaaggtcctgcagtcataatccaatggcttaaatttttttagcatacatttatcaacctttttaatgagggcgagccctgacacagcggtaaagttgtgtcttgttgacttgttggtcatgggtttaaatccgaaaacagcctctttgcatatgcaagggtaaggctacatacaatatccttcccctttacctgtgtatagcgtggagtctccggacaatggggtacatagtaaacatttatcaacctttttaatgtatgaaaataaacttaacatttctactgagctactcattcccatatctccctcataatagcaatatgcatggcaatcaatctcccccacacagtcacacactaattaagataagataaggcttttgctattagtttcatattaagtattaacagcaaatcccatgtaactttcacatattttaaatttttaatataaattaaaagtctagctatcgagcgccctaaattactaaaaaaagacaaatactaaatgacatatacatgcattttcaatataacaaacgacttaaaaataaggcaacaacaaaatataaaattaaggaaaaagcataccgctttggcaggtgcagcttcagttggagcagcagcgccactgaatctaaccccttgagcgtgcccagggaagctactcaaataaaaatcgaaattaacaaaaatcaaaattcgcaaaatctaataaagaaaaacaaaactataatttgcagcaggaaaaaagaaaacaagtgagagaggaacaaaccttggagcaagttgagaagagacagcatcgtaccacttggcagcattgggaaaagagtcttctcctggcttttccacaacagctgcatacactttgacatcatcctttgtcaattgatccctgaactcgaaaacccatatacagattcaataaagcaaatgtcagaaacagtaaaaaaaaatcaattttttcccataaaaattgagttgatgttatgagtgttacccagagatataggttttcccagaaaggaattgatcgagggatttgatgccctcttcggtgtgtagatctgagaaggtgacagccattagtgtgattgaagaggggcagtactgagtagtagtgagtgcagagtgagtgaaaaagagacactccttcgatgctcaataatttatatttatagcatgtacagtcacaaaccctagatcagtccccaattctctattccgaactcaaattcacgttccagacccactttaggaaaaacaaatttctgttttaaaatctaaagtgatttatggagtttattttattttgttttttttacttcagtaatatcatttttaaagtttaattttcccctaaatagcatattatatcaattataaaataattataatgagtttattgtaattgttattttgaatatgacataaaataaggaagctaagtagatgacttgatacattttgattctttaagtttttatttttttctcataattttcttagtgtcttgattataattaagcaattaactattattttagcttttgaaatgtacatgataaatatttgttttatataacaaaatttatgataaatgagtaatttaaaatatttaattctatatgaagaatattctttttaagaaatattaaatctaatttaaaaatgaacatgaaaataatacaaaaaaaagagataaataatagcatttcttgggggccttgaatgaaggaaaataacctattgatgaaccggattggctaacctaatccacctaaaataataacttattgctattttctaatattttttaagactttaaagtgttttgttcaattaattagaaataaagtaaaatcacctaaaatatacttttagtatattgtaatattttttaatattattttatttagtgttttgttcaacactatttttaatttttttttattatagttccatgcttgtagcctatgatgatatatcttgttgtggtgggtgaatagtgaaagatttaatataactaatatttttctaagttattcaaatttatttttttaaagaaaatcttttttagttttcttaaaaaaaaatttaattttttttaaatagattgatggaccaactcatttaactcacaatttgtggtggtccaactaaaccactttttttaaaaattaactttaactagatttagttgaattggtccatttcctaaatgggtagaaatgacctgggtttaacatgatgaaacagtccattttgacaagaaaatctttaatataattttaagtagtgttattaaaacttcggtttaatcattgatccggtcgaggtagtggatcagtgagttagtggtacaaccgataggttagtaattgaatcggttttatccggcatatattaaaattttaaaattatagatgtatctattatatataagtatataactaacattatttgagtaagaaaagttcattcatactccaaaattcaaaaaaactattaataataataaataaaaaataaaaaaatcccaaaaaaaatccaaccaggccagaccggttcgaccgatcgattttggcatgtttgaccgggtcaactgcagaatcggtccaatagtagaatccaaggttatcagaatcgcgattctacatagaatcgtggaggcctcgtaaaatcaaatcgtaagagtctacttcaaacaaaaaaaattacctatatatgaatatgaaacaatgacataactatttttgtcaaattaaacaattgcaattataaataagagatactaaaaaattcaaaataacaattgaagtattaaatttgataaaacaagtaaagtgtattaataaaaaaaagtgtgtaaatagaaattacttaaattaaaataaaactccagtttttaatataaaaaaatgaatcagaaggtgtatagtaagaaaaaagaggtttaggaagcaaatctgttgtggatctggtccaaatacaaaaaaaattactatttgaaacaacgtcgttcctaaatccagtagactcgcgaaaacgtagtagaatcaagattctacttagaattgagcaattctacgtaatatcgtgcgattctactccgaaaaagagtttacgtccgatttaacttgtagaggggtagtagactcgtaaaatcggacgattctatgatttaaattgagagcttgataaccatggtagaaccggaccgattgtgctaccgattctcggtccatccggttcgaaggccgatccgatccgattttaataactatgattttaagtgtgtttgtttagcatcaaactagcattaggacccgtgcgcatacgcacgggacggctccgtttcgctccgccgtgctatgctagatttgcataaaatatttttaatgtttaatgattaagaattattgtataagcaaacttaaaaattgaaagtaaaagataaattgctaaatgtatcagctaataataaattaaggactccactaagaaatgaaaagtgtttcattatagtgtttgaggaatggaataaataagcactgatgtatcacaccaaattttactatcaagatttaaggtgaatggataaatagtagacgacttgatatagtgagttaataataatttactctaataaagcaagcatcaaaatgctttcttacaagtccagaatgcaaattcttacaaaatataattgttaagtgctttaagcataataagaatacaaactattcaaaatataagatgaagtcataattacaagaacaaaacatggttttcaacaaagagtttacatttgatagagttaagacaaaaagtgtctctaacaaatataccagaacacatggttgctgctgtgatcaggaaactcaattacaaactacatatgtggtttgaaactgttgtctcttgcaaataatttccatccagagctgattttaacatatttgcgtgaatggttgaacacaattttgcatgtcttggtttcattaaaaacaatatttgtgaatgttgtcttaattaagaaatcatacatgtttctaggtagatgctgcaaaatacattatggaatgttataatttgatatatgcatataattcactataatattaaaattatatagaatgtaagttaaaaaaagcttaccaaggcattggaattgagatggtgattgaccaagaaaatgtgaaagacaatggcgttaggatttgatttgtaaagagaatgtcattgtggaaatgattgtggtagggaattgcttttgaaaacagtaataaaaaaatagagaattgtcatacaaataacattgtccattcaacatttgtaatggttcaacagattatactaaactgataatgtcgattacaaagacaacaaaaacaaaataattttaatatttatatgtattataacaaaaaaattatttatgacattattgataaagtaatttaaattaattcattttcattatcttataacaaataatcaaacttattacttattatttttctaataaatatattaactaattgttactctgttagttatcgtaataattgaattaaataaagagtttaaaaatttcaaatcttaattaaattttagatagaataattattttcggtaaatgacaattgtagtttctatcattaaaaaataaaattaaaactaatttacattatgatatatgattaagtaatttaaaattttttgtaacaaaaattatttttataaattaattttatttttatctctatcataacttgaaaaaatttatttataatattattgataaattaatttaaattaattaactttgattgtcttataacaaagaatataattattattttctaataaatatattaactaattgttattatgctgattattgtaacaattgaattaaataaaagttttaaaattttaaatattgtttaaatttacctttttattttatatgatcaaattttaaatccaaataatatatttaataaaaataaatattgttgattgtttgatatgtaactgtactaaatactttttaaaaaaaaaactattttcccatagaggttaactcatgatgacatagagaataattatttactgtaaatagtaattgtagtttcgatcataaaaaaataaaatgaaaatcaatttacattatgatatagtgaataagtaatataaaactttattataacaaaaataaaattattgttttattaagaacttaaaaaaacaaacaaaactataacttggagtatttcttttaaaaatcaatttcgattatgtgattattttgtttcactatttattcattgttcaaggtttttgaaacttaaagaaacaaacaacatcataacttggagttcttttattttaaaaaaattatatttagataatgtgattatgtttttgttatagttgggttacaatccttcagatgaggtgggtacaggagtttaaattactttatcccaaattatatattatttaatattgttgattgtttgatatgtaattgtattaaatattttttaacaaaaagtttttcctgtaacgatttgctcatgatggcccaacgaataatcatttcccataaatgataattatagtttctatcagaaaaatatgaaattaaaactaattacattatgatatggtgaataagtaatttaaaactttcttgtaacaaaaatcatttttataaattaattttaatttttatgtctatcataaccaaaaaaatatttactatgatattattgataaactaatttaacttaattaattttgtcttataactaagaatcaaattattattttctaataaatatagtaactaaatattattatgttgattattataataattgaattaaataaaaagagttaaaaaatttcaaatgttgataaaatttaaataataaaactataaatatttttattattttaaaatatcatcatttcattttactgttatttatccattattttatatgatgaaaatgtaagaacaaatagtatatttttaaaaaaaatattgctgattgtttgatatataactctgttaattttttttttaaatattttttctccttcacttataaagacatagagaataaccatttcctataaatgattattgtaatttttaatataaaaaataaaattaaaactaatttaaattataatatagtgaataactaaattaaaattttcttgtaacaattttttttataaattatttttaatatttaaatcaaaactataactataactttaaaatttttagtatttataaattattttcttacaataagtaattttaaataataaaactataacttttttttttaaaatgtcaccatttcattctattattatttacccactattttatatgatgaaaatttaaaaacaaataatatatttaataaaataaatattgttgatttttctatatgtgattgtgttaaacattttaaaaaaaaatttcgtaacgatttgttcatgatggtccaacgaataataattttccataaataataattatagtttctatcataaaaaataaaataaaaattaatttacattatgatatagtgaataagtaatttaaaattttgttgtaacaaattatttttataagttaattataatttttatttctatgataactaaaaatattttatttatgatgttagtggtaaagtaatttattatgattaaccttagttgtccaataacatcgaaacaaactataattttctaataaatatattaacttaatgtaagaattgaattaaataaaaattataaaattccaaaatcttgattaaatttaaataattaaactttaaattattatttttaaaaaaacatcaccactttattttacagttatctaaccattattttatatgataaaaatttgaaaacaaataatacattgaataaaaataaatattattgattgtttaatatataactattttaattacttttttaaaacaaactttttccccatagttcacaaagtgtattagtctcaaaatacttactgattggacaccaaggtggcctagccgtgatgattaaaactttgagtgcatgataaaaaatcataaaatataagtatttaacatatttatattaaatcaaatacaattcatttggtaggaacaaataattatcaaacagaagaaaatagttgattgtttaaaaacgaaaagacaaagatatgatgaaaatttaaaaataaataataaataatatatttaataaaaataaatatttttgattatttgatatataattatgttacataatttgttaaaaataatcctgtaactatttatccatgatgtcctataaaataattatttttcataaatgataattatagtttttatcattaaaaaatgaaattaaaattaatttacattataatgtagtgaataaataatttaaaattttttggtaacaaattttataaattaattataatttgtatctatataataactaaaaatatttataattgtgatattattgataaagtaatgccttttaattaactttgatttttctataacaaagaatcaaatatatattttctaataaatacattaactaaatattattatgcaagttattgtaacaattaaaataataaaaagagtttaaatattacttaagagcatgatgtttagccggaacaaagatagagtgaaactaatattgtccgctgtataagtatgccttaaatacattcatgtataaaagaaacaataatccatcatgattatagaaacaatattgtctcttttacattatccaaatatttagcaaagtatgccttaacccagttctttactatccatcactatctgtacgaacacaatgagtcaaagtcaaaatacacattttactgcatttttacaatattgtttgttgcatatggtgacaagattcagtcacaaattgtataagccctaaatacattcacgtataaaagaaacaataatccatcatgattatagttcgggattgtaaagctatcagtttctagtcattattatctagcataaaatatttatactaaatcaaagccctggtcagaagagtaacaaatgttacagcaccatagtcaatatgtatttagacattacggaaagacacaaaccattcatttctttaagagcagtatcaagatcagaaggactggcaaagctcacaaatccataaccttttgttttaccagtctgcttgtctctgacaacctagtcaagataaacataccttaatcacaacattgtcaacacattacaaggaaataaatgcaccacaaacacataaataataaacattaagtttgcttagagataagcagacgactataaacctcaagttctttagatggtattaaatgtctccactattgaataatatgccttcatatttccatcaaataacttggatcttgtcactaatttcttagtctcgatgaatgggaactactaaatacatatttattttgtaaataatggacatacataagcaaactataaaacatatgctgatttagcttttaatttccactatctaatataacatccaaattattcattagcacaaaaattctagaaggtagagaaatggtctcgactcttgaccgaatagtaagtcaatactttatagacaaagttattactaatttttcagttcatattttcaataactatttaacctattttctcattccaagagaattaaaaaaatacactgttatctctggctaacatgcaaaagtattgtgcagccctccctcttgggtgggaactttcccaagccaaatttcaaagtcactttcatagtccattattttcacccacaaacttatccttatatattgttgaaagaattgcagttagtgacattagcttcttctttaaaattactatgtgtctagacttataccccaaaaaatacaaaggttgaaagaggttggagaattgaagtgacgcaataagagaaagaatatttcgaatggtgaatacaaaattcatggttagtgaaagatcattatcatttacaacaatggttgagggatcattatcatgaacatgatcttttagtgaacctgcccttttctctggctgttcagttagtagtgtcatcaatctagagtctacactaattcatgatgttgttgaaacataaattttatcattgaagtcacatttaagaaaattcacttacaaaagttgtattgtgtgctaaagcttggctcagcaaaatgatctattttctaatatatttttcacaaatatctcatagttgaagattgtgtcaaattcgaacaatgaaatgtaattgaaagcataaatgttatccaatcaataatttataattggcactaatagttagcacatgtttacatttgatatatgaaataagattttgtttgcttataattgttcttaattctgatcgattaactattgactggagatgactaaaaggaataagtacccggcaaggtagagatcgttcaccaagggacaaaagaaggtgggtaaattcagcctcagcctcagcctcaacagaagttgccttaccttgacatactaacatctttagttgacatgccaatttctagaaatatggtcttgcgtttatttacttcatcagataattatttcttatttgcagccaattttcctgaacatagtgtagcatcagaaaaaaagcccactttaagtattaagaagatataagtattaagaagaaagatatacgtcatgatgcccttcatttcagcctatgttactattctaaagaacactatattgtggcaataaataatatcacagaaaacatgacaaatgtttcaattgatatttcaccggtgaaatttggcaaacctactatcttgaagaccttcttgaaaacaatgcacaaaaactcctgaacatgtaatacttaagaagtaaacatttctatttataaataactttataaataattcaagaacacatgtaatgtaaatgaccatgctacctcattcgaatggtctctgaagtccaaatttcgtaagagatgcatagagaagagacaaagataggtaaatgctaaggattgctaaccattctacctagactttattgaataattgtattgtatataaaatgaataaaatgcttgaagtggacatctcagtctaaccttgtcaaacatcacccagacaccaacttcagaaaaatgcagatggaattgagaagtatgagagtaaattgaatcacataccagatgcccccaatagtattaaaaaaaaaaaaagagttccttttcagaaacataatcagtttcataatcaagtaaaagaagcatgatgtgggtttagggtttagggtttagggtccttctataagtatattgatagataatagatataatcaaattatattacctcatccttgttgccagacaatgccttagccaatgcgttaacttcaataattttttgggcagcaaatgctagccatgactcttcaatgcagcagcctaagaggaaagaatagaagccatgagtaacagcataataaattttacaacatatcgaagttaacaaaaagggaagttgaaataagcacccacaaccttctgaacagcctcgttggtcactcttggagaggacttccttgaagcctgagctgcagcattagcagagaagaaggcctgaaaatgaaaccataagatatttttcattagtgaatcgtgtgatgaaacaaataggaatttgcatattttattgtcatggttccaaaattaatcaggaattttaatcaggaaattgcatatttataattacctttcaaatttcaattggctagtaatagaacaatagcaataatgtcatgtaaaaggaaattcaccttggggttttgaccaaaacaatgcatttatgtaattcacatcctcttttgatactccagactgagctaatgccttttcaatgcacagtataacaccagcccctgttttgaggtggaataaagaaggcataagcacaagtgtaagcctggaatgatctgcagggacacatagctatattctaaacaaagcacataattattaaaaagctatatcaacatgagccagaataaaaaacattcactccagaaccataatgaaaatgtggcagggtgtatatagttaatctctttgattatactgcaattgtcatgataaaagtagatatatcaatgattcagtttgtgattgaaagaaaagaagcaacttgcagaagcaacttgcagtcgtagtgacacaaccaacctgtagtagaaaaatagctgaaaaaggtttactttgatgaattttcacagctatcatctcatataggaagcaaaaaaatcaaaggagatacaaaagcgggttaaattaaacaaacgcattatattcaaattcaagccatgaaaactcacaattcactcatacataccttaacaatgtcagatgatagagtaaatctctgaaatactctcgcacccatcaaccatataatcctatcacaaaacaccacaacgttagataaaagcactgcaccaacagtgcatcttcagataatggcataacactcagcattaaaagcacaagcagcccttcaaaactaaatctaagtattttctcttaatctaaaagctctaatgtaaaagctcttatgtaacattgcttgcaactgatgagcgtgatacggtatctactgccaaggtgtgatataaacaaaaaaaatgaagcttgttgaatataaatcggaaataccaaaccacaaaattaaaaaataatgattcacagagcaaggattgtccatatgttcatatttgtcaaataccaaaccacaaaattaaaaaataaaatgaagcttgttataaagaaatataaagttcattcatgcatttgatcaaacacatcacttgcatactacaaatgagaccaatcaaactttaaaaacacaatatcattcagaaatgaaataaaagcaaagcttgatattaaaaaacacaatgtcaccaacaatatcattttaaaaaacacaatatcacaaacaattcacatgcatatataagctctaatgtcttgattttaaattctaacagcaaaataaaataaaaaataaatattgaagaaaaaaaaatagaaagagacaccttgtgctctcggctttctctatcttcattgacttcctccttgctagattctttcaaatgcgtgttgcagaacatgagtcctctgtcacaatcttcttgtcttctctatggattttgtgttacatcacaagcagccattatttatttagtatgtaagacttaccaccagccattatagtagaaattcactgttattatattaaattgttaatactggaagatcatagagaaagatgaaataaaatagctaatataagagagaacagaattccgtgaaaccaaatcatttttcttgaaaagaactaatataagaaatacaaaaaattaatatcttgaccaaaagaaataaaatgccgcgagatcatgcaaataactttattgcaaaactaattttgggattcaagaatgagacaaaaaatagaaaggcctctgattgattaaatattaaaccttgtcccgttatctgcctgctaaatccacagctttttccacaaaatcagagccctatattgatgcacaaagagtatgatcaagtgcataaaaatactaatcaaaactttaaaatgaaagggaacttaccatgtttgtgaaaagtgaagtcatcatggaccggattacaaataaagaaaaaggagtggcaatcctcttaattaaggaaagtctgatcgaaggaatcatatacttattttctcaaacttatggttcaacttgtcaccattgtgaaataatgagtcacgcacctgacagatatacctgcctcaccttgccatgtcttacctaaaggttagacttatttggagtataacttgagttttcgttaataattaacattgtaaatgaaaaaaggtaaaaaaaattattattatcctaacataaagacatatagatatcagactcaaatccaatctcttattaccatcatgaaaaacatatgaaaaacttaagtgaagagattctgcaatccacataattacacagtaaagttctcaatcaaataaaaagcactaaaatcaatcatacccagattacaaaattccatcctgttagtctaagactctaaagcatgcaactgatcctatctaagccactatagcatgagcatgtggagttatgagcaggttcatagttaattatggaagcaacatcaagatacttaaatggatcctttggcaattgagaggtaacagctaatacaatgtagtcatgttgttttaaagccaaccacttaaatttgtttcatctgaaataatggaaataattaaagattcaattccaaataataatcacacaaccattaaatttttctacccctcccaaaaatattgtggtagtttctataatgtgcactgcagtttctatagtgtttcatatctttacggcaagtgttacaatataaacccgcaaagaatcagcagtacattatcaaacaattcctaacttgaagttaacttagcaatttgataaagaagatcaaaatcccaattccaaaattagggtccacactcattctagccattatttattcagaattcaaactgatatgctacagaaatagaagcttgggcatccatataaatgagagaaaaacctgaatgttgcaagttctttgcttttgctcacagacttatgttgcccatacctaacataataactcaagatattagaatataatttaacaaaataaattgtgttaattagttaagttaccttgatggagtgcttgcgtttccagagcctcagtaatggactgaaatattatccacgtgcgaacaaaataaaagaacattaaaatagatccagaaaccgaaactaaaatcgaaccatcatagccaattgaagaacattaaaatacctgttgcaatatacaataaagcttataaacaaaacaatagaaatttgagtgagacattctgtcaaacacttcataagcaaaacacattttgcaaaatacccaaataaaaaaatgcaaagaaaacatacccaaaacgtgaaaaaaaaaaacgcaaactttgtaaatataagaggtataagacagagaagaagaaaatagagaagagaagagaagaaaaaacaaaggcaacgcgacgtggtagtggtctacctcgccgccagccttaatttcatttgaaggcaacgcgacggcggtcggagatggcggcgcaacgatggactggaatggacggagaggaagaaagaaagaaaaggaagaaaatttttgagagagagacagagaaggaatgtagaagaggagatttgagagaggctgagtttgaattcgaatttcaaatttgaaatttttgtgtaggctgaagctgcagcttttcaattcaaattttaaaaatgaccagcttttcactgatggtggtggacgtgctgttttgtgaaggaagagtaaataattagctgaggaaaaaaaaatacaaaaagcctctattttttaagagagtgacacgtaagattttgatgaggtgtcaatgaaataaaaggccacgtttgcttagcttggtattcttttaatataatgtattgatttgttccaaattcatccagcaataaaacagtgtagaatcaaatcttgcatattagtacaaccacatacttcaaatttcagttgcccttttattacgagttcccacttcacatatcgctatttgtttatacgttatgcctacacgtcatcacaactttgttctactttctaagaaaaacacatgtaccatatgtggcagctccatgacaaaatgattgaaagagaacaaatagaagtaatgaaataataacatgaaaatacttaatctacatggcaatgcttagtaatttcgttacttaaccaggaaaaatcattcgttctcatcgaaagctatagagcaatgagcttagattttgccaaagcagaaccattaagaccaatcccgaataaccatttttaaggggttacttaggatacttgataagcacaagaaatcctatcttaagatattattactcattgacaaaatcactttggacacacactcttcaacacaaagtctcgttgggaaactcatactttaataagctgctagaacttacttttgttacacaatttccttgaaccacttgtgtaataaaaagttggagttccttaataaggtatattgaagtcattgacatggaaggtggttgtgatccatgatgcatctagagcaatcaatgttaaaatctttgaatggtctctacatggcttgttacttgtgccaggagatatgctcacactaattgcagtcatgcaccaagttattactcccagtaagtcatcttctctctttttggttttaaaatttgtttgctagaacaattctacgctactcaacaatcagtttctcatccaatatctattaaatgttgaaaactgtttctaaaacaagtgtcttaaaatccaaaaactacttaagtgatgctttctcatattcttctattttcatcttgttcaacttctgcatcaattctacactcttttgtgccttgcaccacttactaccagctgctaatttgaacaatttttttagttgtattttgaaaactaaaaatagtttagaaaatagaaatcaaatacacacttattttagtcatcctctcaaaatcattttatgaagaaagaaaatggaaaataaaagaacaatatgtcaataagatttgtgctgagtaacctgattgcaaactttggtccgaagatattaatttcactaatcaatccaattattggttccctttacatctattttgttgtagtgggttacaaaagcagtgtagacagcaggttaatgtttggagctagccagaagatgattgaggcacaagctgccaggaagaaggaagagtatctgaacaatccggagcttggtcggatttttaaactatacaaatcagaaaaggtcgtataaatactagttaataacattttctttattttagcttataaaaaagaagattttatctattttgttttcaccatgaactttacattgttatctgaccattagaaaacataaaatatgacttgcatattgactagtaaatatttaaaagatataattagactagaaaatgtttttaagaacacatgtttcctaatttcaacttatatgttggcattcctatcccttacctaacttttttttcttcccttcaataccatgttctgtgattagagttacttgtgagctgacttctttggacatgatactagaagatgtcctgataaatttctctacggcagtaagcttaatccttattatactctattacatatatggtgaatatactatttctactccaaaatctcaatgcaacttaatcatgtaaaaatacgaaaaaggtgtgctaaatatattggtgatattttctatgtggttggagggggttataatatcaaaagcatactcagcaatttggtacaaagtagttgtttctacgaagtattgagttagcagtgatccaaaagatatttgttttagtacattctaacttccaactgttaaatcaaagtattcaagattccacaatgtggatattgttgtcaagagtttcccacaggaatgagtatgcattattcacaaaaacgtaagtcactgttttgcttgtgaacttgtataaagtgtaaccagatgacaaagtgaaacgatataaaaaataagagcaggagaagaacaaaaacagatctccctatttctattattttcattattgcaactaatacaactcgttactcatctagataaacaattttacgttttgataaaaaccagcgacaaaatctacttgtgttgcctaccaggcaaaatgaattttatgtatttaagatttaccaaattataaagaatccctgcactcctagtacgaaaacaaaatcatttccattgttgacagtattatggttatgactaaaagcgctaagaaaatagtagacaacactcttctacaacttgtagtttcaggctgtgaaccgacaagtatttctccaaattattgcagatcaaaaatacaatcttctaatgtaagattatatcaaacatacatacactaaacataggtcttgaatgatctacacatctgcttctccaaagtacaattaacattcaataatttaagctgaatagaaacaatagtttggaactgtgcttctccaaaatttgaagtacaattagtactccttgtaacattgtttctcaaaagtacaattaacatttataaacagaaataattgacgaaatcattcaatgatttaagctgttgttttatttattcctctatagttctaccacacatgttttgctcaagataagaaatcattttaagagaactagacctgctgtttttccatcttatgaaacttttcacatcatattctcaggttaggtttaagatagaaacggctgcaggatcatcactgaagacggttgcattgaaatcagccatgaagcaaaaggcaacttggcttatactggacaggtcaaatgaaattaaattgattatctgaattatcttagtctcatggatggactaccaaaaacatgtcaaattctacactgactaggcatgcaagaatgatataaatttagggatattcgtgggtcggttcggatcggtttgggccaaatttaggacccaacccaatcaaaattgatcggttcggttcggtttgattttcagaagaaaaaatttgaaacctaacccaacccaacccgttcatgaacagttcggttcggttcgattcggatcaccgggttacccatttaattttttttagaactactattttatatcacgattctttcaaatatcccatacaattaacacaatattatcaaatgtatgaaagtagtaaaattgattcatttaataccatcaacataatattctaaaatagacttataatataaattaaaataaaatatttttgaacaagatttactataatagtctgaattacaacggtttcttacaaaccaagctttgttataaccaattttattgcaacaagatttgctgaaacaaacaaataaacaaaatatgattcattagtattataaacatggtaaacaaaatatgtaaaaaaaggtcataaccttaaatcaattcttatttcaaaacaatatactgttagtaccttagttctaataaaattttccattattttgatttcagctacttaaagttttaaagtagggaacataactcaaatgtctaaaatacaaggtcctaaacagttactgagtgccatgatttatttatataaaattgtgtatggtcaatttaagtcaattgagaacttttttaatattgaaaattatttcatttggtccaatttttagaagcaatcgagaacttttttaattataaaagtttgctattaaaacttctattacatatgaatattgtgttggtcccagatgaactcaagaggggtgaattgagttttataaaataattaataatttaaaatcaaactcaaagcaataatatgaagataagagataaagaagacacaatcaattttaacgtggaaaatccaattgagtaaaaaccacgacgtctaaattggataatcaatccaatggacaactccactttgataattttgtgtacaagagttcctagtatcctagtttcctagtctacccttaaacaacaattatcccaactggtatccttgtttctcagcaaaaagttctattctcaattcatcaagaatagagacagactaatatccctgttttccagccaaactggtatcctagttttccagccagaagtcacacgtctcaattcatcaagaacagagatcctagttttccagctgcgactttttccaaagtcaagaaaaataatacaataaaatagttaccaacgcttttattccttaagcaaataggtacctttaaatcctgatggagagttgaagaatcagacttgtcaaacgtttctatatgatttcacaacaattctctcaatgatgtaaacataaactctctaaaactctaatattatttggaatggaatgcatacatgaacactaaaatatgtttttatttatagtaatttaaagatatgattttaaccaatttttgaatgcaatcctaaatatattctatcatattatccaatgcagtcttaaagatattttattatattatgcaatgcaatcttaaaaatattctatcctatttttgaatgcaatcttaaacatttaagataccatacctttttttatggtcaaattatttttttaatttttaatatatatatatatataaataataaaatatatattattattacgggtcacagatcgggtcatcgggtcaacggatatataaatctaaacccgtgacccaacccgtacatgaatggttttgatcggttcggttcaattttgatccaaatatataaataacccaacccacagtgttcggatcggtttggatcagttcgggttcacgaatgactcgtacccgtgaacacccctagatatatttcttttgaaacccttcatttgaagactattcaagttaaaacaaacagataatctaataaaatccattaactaaggtctatggggcataatgtctaagcaagtcataccttcctactaaaagaactcttagatttgggcattacttacaaatcaatcaccttttacaatttcaagtattctgtttctaactcacagcaagatcacaacataattctgacatataatttcttttagtcaaaatctattatatatcaatctaaatcattcaggctagctactcactcaagcaatagcaagttaggccttgcaatacaactgcttaaattgaagtatacattgaacaaaaagaagaaagacaaaatgatagataacttatgaattagtctacgtaggtgaagttgaattgggatgttttcatttagttatgggtatttgtaccagtttattaaataacatagttacaaattttttttgaaaattatacactggttgaaaccaaatctatataaatacatacatgtagtccagcattctcaaatttaagagctagaaattatttcaggatgcaggtaactacaaatatacctttcttttgcttaaacaatgaaataagatgacaaacaatgtaactatttcaagtgcaaaatcgtaacccatttttagtgaattatctaactacaacctcatattaatgtaagatgcatctgggtggtcacaggaaaatgaagaatgatgagaagtattttctccagaagctttcttgtggtatattaagagtaaggcgtttcaataaaattgtacgtttaagagaaccactacatctccaccaagaaacgcgacccggtagcacccatgaaacatacacagatagtataccactaccagatacttcaactgaacatgatctttacctcttcagcactgagacttcccccaacagtaagtactagaatacttttagatttaacatctattcataatataaccatgtgatctttatcggctccaatattttcaattgttttcatttttgcatttcacatgtgggttagcattagatatgctttgttttattgcatgtttctcctcctgaccctcagcatctaaaatgataggtcaaggaagagataatcaaatgaaccaggaacaaggacaaaccctaaagagcctccatgttgaagaagggttctcaactcctgatcagccgagcatagaagaaaaagacaatagtataaagcacatggaaagtcgaacacaaagaagccaaaactggcaggatgaagaacaaaaagaaagcatgaaccatggaaacaaaacagaaaagcttatgcaccaaggcgtatcagaaaggtggggaaagatgctcatcttttggtggagctagaaacttttatcttggaggggctgaagaatacagtgtgaacagtttttttactttgagtaattttcatgtgagaaactagtttcaaagtcatacccatgtatattatttacacattagcagtttttgtgtcaatctatcttattcctctttggtcacatccacaatatgatggtaagattagctaatgtggatcactatctgtcttaattcatagagtaataatagtgctaaatattattggtttttatttcacaaaatgataactaatactggattttagcaaaatctacattctcctaaatcatcaatctaattattaaatcgtatctactatctagtgactagtgttcttgaaatccatgcatttaaacactttggtgtacatgaaacctatgcctaaacaccctatgaatcaacacatcactcttgaacaaaaaggtaacagcatagcagaattcttctacttctcagtatcaataaagtattattcttgttgagcagctacacgatcttcttcactatcaacgcgtaccccatctttgttattggtaatatgccatcttggttgcatttgcaaatgttttgatagatcagtagccgtctcttcatctgcattgaaacaacctttgctctcttcaatagatgagttagagtgagaactatgcttatgatcagggggagagaagatagaggagggtgaatgcccttccaattcctatcagaatgggatctcatgtgtccgtagaaggacttataggatggaaatgatgccattgccattagagttattattctaatacggatagattctcttatagaatggatttgttataacaatcatatctttatgttatagatatagaatatgttaggtttgttatggttataggatatgttatctgttataacaatcatatctttatgttatagatatagaatttgttagttgggtttgttattttgttagcagaatttaaactctatataagaatataggatgttgggtttgttattttgttagcaaaatttctactcatgtaaactctatataagacttttttgtcgcttaattcaataatgaagaaaatacacaaaagcataaaatctcatgatgctttcctttgagcttgaaagtgaaatcttttgtggccccctaatgctttgccagagctaaacttcttgccacaaaattcacactggcgtgttgctgtagcttagttagctagtttctcatgtgtcccagcttgatcatcatcagcctgcatgtggtttatcaccatcttcacataactcaaaatgtgaattactcatcttctctatttttttcaataagatatcatcaattcatcatcagcttcccttggagaaaaataaaataaactaaaaagatggaaaaagaaataagctatgagcctactactactaaggaaggaaacaacatgaaagagcataacttgataaacgagaagaagagagagaagataggatactaggatcacaatgataatggaaaatattttgaaagcaattacatggtattactttttcaagataacatattttgattgaaaatatatctttaattatcaatttatcaaagtcaatttagctatttatcgagtttgttaatgttttttaatcaccttaagattgctagcttcatggtgaaatttcgaagtattccctaaactttcataaagtaacattttaaatatttaatatttcccaaaattaataatataatttatcttaattatcttagcttagttaaaatataattgtaattaatcaaaatatagtaaacaagcacaaaatatactaatcccctttcaaaatagtctttatattattagtatttttactaaaattttaattaatatactatagtaattttatttaaaagatcaactccacataaaattaaaagaccagttgcatagtggagaaacgccaaagaaaggggacataagatataaaatatcattattattaaacaacatatagcttaggagattaaagcacatagaataatagaagacagtaaattaaatatatgcaaacaaaaattaattcagctgataagaattgatcgaactcatatcttataaaatatgaaatcaatttttgcaaccgaagacatctttagtacataatttgtgagtgttttttaagttttgagattagtcacccagaaccaacttatatgcattacactgagttactcgataaatatataacactgaatacacccttataaaggagttgctgtaaacattaaaaaaaaaaagggtcatctatacaatctcagaaaaataaagaatattcatgattcataacaatcaatgactcccctaagaataaaataaagaatgaaactataagagtaataagacaatattattattattattattattattattattattattattattataataataataataataataataattattattattattattatgagccagaagaatatgtagctgttctgtcactcatgatggagccttgaaaaagataagcctccaccagagtgaaaccccgcagctttattaatagctcttacaaaattctgcaatttaagaataattatatattagtgtggaaaaaaggggtagataatgctgtataaagtatccttaagagcatcttgatccttgtcataatcctctaccggactagagtcacctaaagtatcttggtttatctggtctgaattttctttgtttcccaaacttgactctcctttcatggaacaatcatctgatccttccacaatctttggtggtgggcaaaatatggattccaaaaacccattgctgcgtggagaacgtggttcatagtgctgatcatgagtctcagtcggaggatcctctctcactctcaatgagtaatcaaatgatggaaatggaagcaaccctgacattgaggaagtgccacaagacatgtaatcaccctgaaactttatactatacattactttgttatataaaaaaaatataaacacacaacataggaagctcataaaatttctcatacttactaatccattggtagcatgtctgagtcacgaagctgcttctggggacgatgcataatttgctgcttggggggatgcataatttggttatctgaattaccttgttgttcaaagatgctgtcgttttcagcaggcatcattgaaatgggtggtacacacacggggtgttttcgattgacaaacttgtaattgtcgaatatcaattctggtacattatgagatgatgtgcctgcttgtgagtcattagcatgttgggtggaagcattttgagaactactctgtgggctgtcaacattcaacacttgttctatgtcttctgggtagagtggcaagccagcacgtttccttttcttttgtcttgtgttccaaaagttctttatttcgttgtctgtgcgaccaggcatctaacacatacaaatgaaggcacaagtaaacacttatatgaagcacccatactttaatttgttccacgtattcaccgtcaattcaatttgctttaggtattcgatatcaatactagtcttggatacttcaggatatccaaactttttaaacatattatcaaaattcaatataattacatgaaacacatcaatatgtataatataaaacactatcgatcccttaatgaatcaaaaatgcaaattattctccttatacataactttaagaaaggaattagattaattataatgctatttctagtaaataatagagaataggttatgacgacaatggtctatgttacggatgtatctgtgacctgagtctacctagatgattaaccacatacaactgaataacacacatggccactgctggttcaactcgaaggactcaaataacttcacgtttagtccttgtttatgaaatttacttcttttatcatggatgagacaaaacatctataacaaaaaagaacaaacctcttgtgccattctggcccatttgtttcctagtaaagcatgaagttcaataactttacgttgttcttcttcagtaaatgctccttttttcaagtctggtcttagatgatttgtccaccttaatcggcagctttttccacaacgagctagtccagtattctttcgcactatattccaatttcccactccattgcttgtcacatatgccgccaatattgcatcctcttccgctgtccatggtcctttctttagaaaagaatcgtcttctgttaactgatcatcttgatcatcgtcaccattacttttctcgtgtgggaacgagttcatcatgactactacttattttaaataaaaataaaaattaatagaaattccaacgcatgctaaaaaaactattaacaaaagaacttatacattaacaaagaaagataaaaacaagagaaattctaatgcatgctaaatgaaaataaaaataatcaaattttatttatttttaagagcaaacactttgaggttttttatataaaagagaaaggagtattatgtgctaaaaaaacaccctacatttaagagttttgctgtgtggaactcttttttaagtcctctctcccccttatgctaaaactcgttcaactattatttagtgtcaaaactctcaaatctttaaaacattgattataccttacctctgagagacagaaaggtgatgctgacggcaatagctgaaaagatgtctatacatacgttgagttctgactcagattgtatagtgtggagaactgcacaaaaaattccctggctaattatgaagaatatatgaagtctttgactagaatcagtttctttttggtaaattgagttgattttataatggcaaaagagtttatcacatttaaattgataataccactgagtggaaagattagtaataagcaggtttgataatctttgttactagataagcgaatcggataatgaagttgattggatgtaaaagaaacaaaaaatttaaatttaaattttcaagttttctatttaattttaaagtaatattttttaatatcatataacaaattattcaccagcaaaatcttttcacatccactacagattctaattcataggatatggatttgttttttaaatcaacttttttgttgactggatcaaaaagtaaattcatttgtcaggggaacttcaaagttcaaactcagtttgaaataaaaacaatttgatatcttttttttttaaaatagtacgtttgatgttaaaatttaatttgaaaactcaattttagaaaaataacaattgaaatatttttgtaaattcagtttataaacttaaatttaagtttgcaaattacaatccaaatatacattttgttgaaggagtgtttgtttctaatttcatattattttcacataatcacatttcgaagaatattatgattcgaaatgttatttttggatatatttaaaaatatttgtgattatattttaatatttttagaaatatcttttaaaattcaaaaaataaataataaaggaagtttatgttatttttgaaaataacttctcttatcctcgtgaaatatcttattctcgtattgttcatgggaacaaagtgtaaaagaatatgttaaaaaatttatcatatttatgagaattaataatatccataaatatgttttcgaaactaataacaaatatgggtatataatactctcatgttataattttgggaataaaattttattctttgaatccattaaatatacatactctttaaattttataataagtagaatctaaattgattttaagtaagatcaaattaaatccattttaaaaaagtagttaattgaaaattttaaaagtaaaatatctaattgattttttaaaaaaaaaaaataccttaattgaacatacaataataagaatatcaaatttaactagcaaaataagttagaggaaaaaaaattaaatcattttattatagactatttccttaccccaactaagtaaaatttatgaatatgtcattgtgcatgacacaaaataaatgtttattttattcaactataatttataataaaaaatatttttaaatataaaaattatattataattaaaatttgtaataaatatttttaaacatataaatatattttaaatttatgataaataatttttattgtgatagattgttatttttaagataatttctttttaaaaaatttaaattcaagttaatattaaagatgttaaaatgatagattgaaagatattagaagttaagttaacctatttagataatattaaaaattataagatgatatatacatcttagcaacatatctgaattttgaaaataatatatatatatatatatatatatatatatatttgaaattattttttgatatttagttacgaattgttaaatcaaatcattaaatatggattccaaaaacagtgagtcgatcaaaacaggtggtgcagtgagtcgatcaaaacaggttgagttcatttagacatttacggaggatgaaaccccccataaacccttaacgcccgatgtaagaagtagtgagaagccgcaggtatggatacacacagagacataaacacaaacacttagaatgcaatggaaccctgtgaccgagagaacaaccacaagaagaagaacattcccattccaattcatttgatccatgatgctcccactcaaacatgtaaccaaacaccgtctcagatccaaatccttcatctcctccattctcgacctgtgctttgaccatgctgcatacacttctctagcatcatcatcaccctcccaatcaacatcatcctcagcctcaacttccttttttatctcccaaaacgacgtcgcgtcctccttcaacacgtggttcgcggcggcgcggcagcagcagctccccttcgatcccctcctgaaccgcatccaccagatcatctcctcccccgacgacgaggaattatccgccgcgctctccgccctccgcctccccttatcggagcgcctcgtcctccgcgtcctctgccacggcgccgctcgccgcgacatcctcccctgcctcaagttcttcgactgggccggccgccagccccacttcttccacacccgcgccaccttcgtcgccatcttcaaaatcctcgcccgcgccaacctcaagcccctcgtcctcgacttcctcgacgccttccgccgccgcatctttcaccaccgcgtccgcttccacgacatcctcgtcgtcggctacgccatcgccggaaaaccccaaaacgccctccacgcgttcggccgaatgcgcttccacggcctagaccttgattccttcgcctaccacgtcctgttggacgccctcgtcgagaaaaactatctcaacgcgtttgacatcatcgtgaggcaaattcgcgccaagggctacgagaatcacatgacaaatgtcattgttgttaagcatttgtgcaaggagagaaggttggaggaggctgagggttttctcaatgggttgatgtgtcgtggagaggagttaaaagggcctgaagtgagttttttaattgatgcattgtgtgagagttataggtttgagcgtgcggttgagttggttaagcaatttgggagctctgggttggttccattggatcatgcttacggggtttggataaagggtcttgttcggggtgggagggtggatgaggcattggagtttttctctcagaagaaggactctgaagggtattttcctgccactgttaggtataatgttttgatttgtaggcttttgcaggagaatcggcttcacgaggtgtatgatttgttggtggatatgaatgagagttgcattcctcctgatgtggttaccatgaatgctgtcttatgcttcttttgcaaagtggggatggcggatgtcgcgttggagttgtaccattcgaggtctgactttgggttgtctctcagtcacttggcttgcaagtatttgatacttactttgtgctgggatgggggcgctgaggaagcgttcaaggtgctcagaagctcggctgagcggagttattttcctgatgggcggacattttgcacgcttgcgagtgctttgtgcagggagcacaagattgatgagatgaaggagttgttgtatcttgccgtggggcataatattgtgcttcctacgtcaatgtatgacaagtacatattggctctgtgccgggctgggagagtggaagatggttatttggtacatggggaacttaagagtgttgctgccaggacatcgtatgttaagatgattaagggttttgttaagtctggtaggggagatattgctgctcggcttcttgttgaaatgaaagggaagggtcataagctgattcgtccgctctgtagagatgttatttgccgcttgcttgaaatggataattcaagagggcgctttttcaatctactggagatgctgactcgttgtcaacattcttgtcagacttacaactttttccttgacggagctggacatgctatgaagcctgagttggctagggaagtatttgagttgatgcaaaggaatggtattaagcccaatttgtcttctcttattcttatgttgcatggttatttattcaatgggagaatttctgatgctctgaatttttttaatggtgtacggcaccagggtttggcaactaagaagttatttgttgccttgattactggtctctgcaagttcaataagatagacatttcacgtgagtactttttcggcatgttaagagttggattgaatccaagccttgaatgctatgagctacttgtgcaaaagctttgctcattgcaaaagtatagtgaagcaatacatatcattaatgtatctcagaaaatgggacgtccactaagttcttttgttggcaatgtacttctttatcattctttgatttcaccgcaactctacgatacatgcatttatttaagaggtgtggaagagggggtattttctggtaattcaacactttgctggatgattggtgcattttctggtcgtctcagagtgagccattatattgcggacctggaaagattagtagagaagtgctttccacctaatattttcacatacaatttgttgctgaaacaagtggccaacagtgatatggacaaagctcgtttgttgtttgctcggatgtgtcaaaggggttatcaacctaattgttggacatatgatatcatggtacgtggtttctcatttcatgggaggaaacatgaggctaggcggtggcttgaagaaatgttccgaaaaggattttatgatgaaaatcaatagaatattcatttaaggagaattggacaaggtccaattaatgtgttaaagatgtagaatggtttatccaattttggtaaggataatatgatttctattcatttattggaaaaatgggctacattggatgcattggttttagtttatctgtttaattgttattctttagaaatccttgtatctctattcccctcccccttttcttcttttggtggaagcattgggaaatcaaatatgtttccaccttgtattattcatcacactagattgacataagctatgatatttggcatagcttttatacattattttattctccatactgaatcgttaatgttagaagctttgcttcttatcctctttttgtgctattgtcatcacacaatgaaaaataatatcagattattcatgaatcagtactcaattttgattgattttgagtcttgaaaaagtagttgttagtgtcactaattactgaatcattgattttggtttatctacgtgattttctattcaaagggatttgaatatgattgcagaataagagctgatatgagatcgttgctctcagttatatgtttcatgtggcactttcttactttcttgtcatctgccatgatctaatatcatatgttttatgcacttgttgctgtattctctcatcaagttgagaatgtgctcaaattcattgagaaatggactgcttacttcatgatggcttgggggtttaatgccagtaccatattggccatggacagtagtcattgcaacaaacatattgtagttatcagagttaaaagggatttgcttcatacatctacctagtaattttccctatgagcttccttacatcctttcttgtaagcttaatctgttgtggtttattatctttttggcaagatttttatttatttatttatttattattattgtggcatgcaaaattacaattggtgccttttgctttgatttctttgatgggcagtgtttggaacttgacattatcagttttgtgtctcttctgtcatttttagtgtcaggttatatgatttatgttaaattcctcaaaatctgataccaaatttgtttagccctgccttttttttttttatcattatttacatactttctactttctagtttcaaccgattaataattaggatcgctcaggtttttgaggcatgatatacatacaatggtattcttttccctcgaatcagatgttttctggccctagtaatccctccattcataactttatttgaaaaattgtatgcaacatttgaggtattggttggattttgcatggcagtagtacttcgtggccaggtgcattctcttgtcactgctggctgaatctaattgaaagttgaaatggagaactggtcttgtagaaagaaacagagaagagaggaaaaagttatgaaagaagtaaagaagggaggaagaagacaaataaagaactgatgcagctaagagagccattagtccgttaccttagaggtcctaagaactcaagctgtaattaagtaaaagagtactcctgtgtctctaattataaaactattttcaaaaaattgtttttttttttataagattcttttttaatttttaaatatattaattattttttcttacacgttcttttttaattattttctattcaaatattaaaaaaaacaattaagtagatagagagataagaaaatgataattttggaatgataatacaaataattgataagtataatatgattaattaaattaattgtttttttaagggttgcaaattaattgaaagaagtgttgaagtagagagaatgaaactcacaatggagcatgggcagtgcaacaaatttaagtttgaacttttccgttagggtttaaagagttgcatcttatctaacattacatggcaacaattccttatttggaatatccgtgcatcatatatttgagatattaattaagtcaattgaaatgtttggatgtgatatgaatatgaagaagctgataggcaactaagcatctcattacagaaaatgggaataacctcacacaggaatcagaatcacaggttcattactctcaaactctagaaaacataaaatagaatactaatctatgcaacaaattttttagaatactccgaatagattgatttaaagtttagctggatagttgcatgagattaatagagaatcacggaaatgtaatatatataccctatgcaacctttattttttgttgcatctgacagtaatttattctagttctttaacagaagatggtaacataaataaatgatggttaggaggctttttagatgtgagtaaaactcatattggagaagaatatggttcggggattacttttattaaaactttgtttctaattgatccgggactcctttaccttgaaaaatcatacaattacctcatgaaaaagcatttatctttaagaaagtttgatgaagacaatagaacactcggtgcatgatcaagaagagagaaaatcgttcgcttgttgatgcctattgttagcaccatcccagtcattgatttgctactacaagaattcatcgtactatggtagccagagttcataaagtctttccattgtttcgattaagccacaaagcaagttggtagtagctagtaggaaatgttagattgcaacttcaattttcttgtgatagtgggatactaggggcggattctagcatgcatgctatacatgaatgatgaaccattaattacttctaacaaagaactgaactagatggtttgattgtgaaaaccagtttcaaatggatgatgaagaaccaacatagattgccttaatttttttgtattattttaaagaaatttattcaacctttttttcactcgaataaaagtttaatattaagttataaagtttcatttatatataatagtatgaaatatttaaagataaaattttctcattcataataattctaaaagtactaaatttgaacaagatttgagagtatatatctatggtaaaacaatgtgttacgtgcaaatgaatcgtgtattactgaaaattagtgttgcagacgctgtccacgtatgcagggtgtttagttattatttaccataatgtattcttttgtgctttgacagaactattcattttctctagtttttcagtcattcaaacttgtaattatatgtatcccacgtagtacagaaatagggtttgaaacaatataacaaaaataaagacctcaacgcattctataaatgttggtttactaatgtcaattgtcaatcaacggaatagataataccaaattaaaccaaggaaaattcagaacccaattattacggataacagtaattgtacaggtaacagttattaccacctgtgctcatgactgagcacatcaataatttcatttttgcatttaaatttatatttatttctcacaattgctaggttgatgaatgaaggaatgaaatacaaaacaaggaaaacataatttctatatctttccatcaattccgaagtaatcaatctttaattataaaattcttttagaaatttatttatctctttttatataaaaaatttgtaatttttagatgcattgattttttttcttcaacatatatttacttaattattttcttcaaacattaataataaacaaattaaattaatagaaagataagaaaatgataattttagaatgatagtataattaattaatagatttaatatgattaataaaattaattattgttcttaaaaagcataaattaattaaaaaaatcttataattaatcacgaatgaagtacatagtataacgtgagataaaggaagtgcaagtggctaactagattcacattatttttaatttgtctaaaagtggaaggaaaagtaaagaaatgagtgttatttttttacaaaaagattaaattgtcttcttttttatatatttcttttcatttatagatagcatttatatttattctattttctttttacataattaaagaagagaaagaattaactatccttttctcattttaaataatttaaaaaatcatctcattaatcttctattttttctttcttttttcactttctttcctttcatgtttttctttaaaataaacacaccctcaaggagaaggcatattatattaggagtgtaaaacgtttttaaaaccattaaggtagtgaaaataaaagtagtttattatctaaatttttttaacattatgttttgtttttattttcattgatcacataactaattttgactattttcataaatatttttttatttttccataatcttttctaataaattaaaactgccacaacttttctttttcaccttaaaaagtaaaaaaaaatgttttttttgtctcaaattttttatattaaaaactaccttaaatatttatgtgaatttataaaatcgttaactgtttttagtgacttaaaatcataaaatgatttataattgatcaatattattaaaaaagactactacaacatagataaatcattgaataaatagtcatttttatcccttaatgtgtaaaacacagataaattgatcctcagaatatgaaaatctaaattttagtcctaatgagaaaagtgacaaaattatatttttaataagcataatgttgattaataaacacaatttgtctattgtaaaatttctatttgtgacaatattagatagtgacaaaattaagtttgggtcttttttttaagaattaacttaataactatgcatttttgtttgagtctcatatttggataaaatatgtctcatatttgtttttctattttttttaagtgtttattataatattatgtttgcaacgattaaaaaagggatgaaaataaaaattaaattatattttggataaataatcattttcgtcattaaatgtatagagcgtcgacaaattaattcctgaatgtatcacatagactctttcattaatggtaatggacgaaaattaatggattgatttgtcgtactttttttacttttagggactaaaatttaaatttttatctttcataaacgaatttatcaaactctacacatttaagcataaaaatgactatttattttaaataattttaaaatgtactttggtgtgaaattcagattaagacaaaatattacaaagataaaaggcataataattgactattttttcattgtttcccacttaatattgacaaacaaattaccaatcatattattcgtttctttctttattgcctccttttatcttcctttttctccgatcccccattattgctgaaacaattagcaactattgatgggaaatataagtggccaaaattatcgtgggtaatagttctttttcttttcattagccaattaatattagataactgataaaacagaccacatggacaaattttaatttgaataacttatcgatgtaaagggtaagaccacataaccaagtccagcaaagcttctactattaatggtgaatatgtaaaatcaaaagacgtctttcatcagttcatagtagtcatcactactcattaagaaaatggagatcaataatatgcctatatatatatataatatagatatgtatgtctacaaatgatggtgcttttgataataactgttgaaaaacgtgggaaacctttgcaaatgtggcttggctagcattagaaatttagaataatcttatataataataacaactatttgtagtttaatgaaaaatttgtacttaaaatcaatcccttaatgcttagagttgtgttttctatgatatttcaattaacttttaatttttttattaactgaaaaaattgttttactttttttaataacttcttaataatttttagtgattttttaaacattgctttaaaagtaacgttttttaaaactttagtttgtagtttttttttatatttttttatttttattctcaatatattttttaattttctagttattatttttaaataaattataatttaattattttctattattttatatttttcgactactttaacatctagttttattgaacatttataatttaataaattagctaattttttagcttctaaatatcaacttgcaactaattttccaactttcaagctaattttttaggtaatcttgttaaacataacctgggttaacaaaatgaattccttagtagtatatattgggttacttaatccttaaaatacttattttgtaaaatataaatagatttcaatgataatgataagaatatacttctcaaaatattttctttcataagcaaacaaaattcaaaattgaacctaaaattacatggttaagaaacttgaatcctagccacctaaccaaaccaataatttttttttttttgtaattgttgatcaatacatattgattccattgtcttgcatgaattagtgacttgcatgtggacaattgtagcaaatacattgttcactacgaattattttttattgaaaattcagtaaaaagtgcaaccttagcaccatcgaaaataaagctgcgcatagagagttagagcttaggtagttgcaatagtggagaaatgagtaggtcacgagtttttgtaatgataatgcctctcacataccaaaatgccgcacatatataacacatgaagagaaagacgataggacatgaagaatttagttttgatcgtataattaaaatcggtgataaaaattagattcaataaagtaatattcaatatttgtgtatagttattgctgtaaaaaaaattatttgtgtatagttatataattaagattaatttctttcacttagcaagccttaagatcaaagttcccttagagtgacgacttttgaagaattgaagtgtaatcaataagctgtatcgaaaatcttttgaaaagaatgggaaattaagagaaactaaatcaagaagtaatatccaaaaatctaagctgatagtgaaagctatatgtatatttatatattcccttaataattttcacgtgttatacagttgaatcctttctttaatttattcatgaacagcaaatgacgtccaaaatcacttttacattcgcatcaataatttcaattttttgaatatggcattctgtgggtacccttatattaaatgaatttcaactattagggttctcatgatggatcaccaattgctttccaagaattatattctatatatgttggtgccctcctgcgcagccctgattaggaccaccttaagcaaaacgataaattttatgtattttattttattactgcaattatatttatattttctcccctaaatgaattattactccgatcttagcattttttattattatcttgatctgtttgatcatgaactcacaagattaggatgcatttagtaatccaagcattactattcctcaaatgctgtgtgaaatcacctgattagatgattctttctggttttggagtggaaggagaaattatttgatagttttaaactatttggttcttaattaatcatcacataacttatgaataatcaaatgttactatttctttgtaaattaaaaaaaatctaaatgcatgttatataaaaattgattaaaactctaaatatttgatatttcaggattatcaaataattttttcgagatagtggttaaaatcaaagaaagaaaaaggccagctggcatcatgcactctaacacattctttattgttagtttaattttgttagaaatcacaatattgtatgagactcatttcttatttaatgaatctcactcataattttatacttctaaaataaattttagctaaatatagagaatacataaaaaaaagtgctaaagagtgtcactaatactcataaaaaaaaattgcaggtaaaattgcgcagactcttttaattagggaaaatacgtttggaacaatagacgatgccataaccaattagagtcagattaaagctataaatcctaaatgacagagaggatattttacctatacttattcgtaattaacatagtgagtctacttaatctcacccaaaaaaaaaaaaaaaatagtactgacactacgtacttaattaaagtgaaaacaagagtaatttttatattcttttcctcctagtcatcccatgataattcataattctccctaacctgacatcattataaaagacaacacatataatcccacttttcataattatatatcttcatggtatacaaaccttataatacgaacgtgtagtagtatactgcaagttagatcttagaagctttgctttaacaacaaagaactgtgaccaaattaactatatatgtgagtaaaattttctcaaaaaaaaaaaaaagaactatgagtaaaacagaaatcagccatcgcaatacaaagtggcttgtgtgctttttatatcaacatttatttatgaccaaaagtaaaaaaggcatcaactgcttcaagccaaactcattcaaatattttctctttctttgtaggacatgaacctagtcatatgttttatgctgacaaaatgattttcttgttcttattttaagcatatgtgtatttaaattagagagtgataaatataaatggagaaaggggagggggggttcatcaattttttatatgaaattatgaacccgttcacatccttgttaacggaaattctcactttccaatgcacacaaaaataagaagtaacaattgttgaacggacgtttgaggcttgccaactacaaatcaaacacactctatatctcaattccatacatatatacacctgtttgtttattaacaatggaaaaatggggggaaaaataaatacacaccaaaaagtaggtcataactttggctgatctattcaatcacctagtgtaatacatatatatgatccaaactgtaaacagagaagagaaaagaaaaatgagaacaagagagagagttatgtggtggtgttgtctttagaagttagaaaccaagagcaacaatattcacaatatttcctacatcaaaattgcatatctcatgctatcacttaccatgagatggttcatttcagacacttctgagaattccccagttacccaaaccccatcagagccattatttacctgaggctgagaaacacatgagagtattgatatgggggcttgaagaatgctacacacaagcccccaaccatattgtcttctgcccctctcatgtccaaatagctctacaccgtttcctgcttcaaacatgctctcatctgccaccttggaactctttcttgtgttctgaaggtttcttgccactgcagctagaagacgccacatcttcaactatctttggtttacttttgctacctagaacttagattaattattatatatatatggttctcagctagttggagtaagtaaagaatattggagactctgaactctgcagagaaaaacaaagggttgttggaagggccaacaatttctacaaagccttttaataatggtattttggtggtggtattacctagtgcttgtgtttttcacaaaagatataatcatctagtatgatatgatatgattgacagataattttgtttcttcaatatgtgacgagagatttaatttccaaatttgtatatgaaaaaatatttattaagagatgttaattccttaaataaatattaattatcgaaaaattagtctttgactctaagtgagatatcattcacccaaaaatttaccacaaaaggtttgttggtgcattgtagttttaaagagggcaactatatatgaagcagcatttctcttcccattaatcaaaggtggggtctagtatgcccaacttgccgacaaagctgcctaattgtacaaaaagtcttttgaggagtctttttactatcaaacttcgggtttacttttgctgagttttaatggtgcatcagttacacaactgtttttaccttaacacaagaaggaattttaaggtatggcttttacactttacagttcatttggctacaattagaagggtccctaacactacacacatgaagctttggacaaaaggtttagctgcagatcttatcaaaattatgtagggtggtatcaatcataggattagaaacttcagcagagaattttaaccgttcatgattgatctttgtagacatggcttgtttactagaagagcaattcatcagaataatgcaaattttttgggttcccaacacatcaagagtcaatataccggtgccaaaatgtgatgcagacccatgtggaagtttgtcaatgagtactattcctccactaaagaagccttatcaacttgtggaaaaaccaatgcctagataaaaatgcacacctgattaaacttgatcatgaagcaattagggagaaaaatatgcaactggattatcattaagcaaaacaatcaagtatataatgacttcttagttatctagtattaataaataaatgttgtgtgagtgatataacttttttttggtgaatcaggatattctttggctgaaagtgaaagactatttcctcaagatactaagatttatttaaggggttgacctcttccataaatcatgtgactaaggactacaaaaattatttatttcaagatacaagataaatatattgtgctaaaactaaataatgattacttgcacgcaggacatctaatcaagctattcttatttcttaataattattttttcccaaccaaatgtgaatttgcatgatccacgatcaatatacaacaagtcaactcatcacaaccataaggataaatacatgattatactcaagacgtagtccagctaaaattgacaccaccaccaaccaaccttccatttgtttgtagtaatatcaatccatcactcttccctctctgtctcacaccctcactttcattccttatctagcttattccattgacttaatttggcattagagtgttcgtgaaccgaagaccttcaattccttcatcatagattgaccctcatttgcctagcaggaccactgtacactaccaactaaacattcctcaactattgcatttgaagtatctaattcttttggaaataaaataattaaaaattaaggctcttttgggtatataaactcctccgtaactaattaaaggaaaggaaaataaaaaataaaataaattgagtttttttttttcataagttaaaatcaatttacatatttaacttttatagaaatgccctcatttaagttttctaaaagttgaagtggatacgtcgattttaacatatcggagaaattcaattcagtttatctaaccaccagaatctaattgcattttagttaatatatagtatagttcttggcttgccaaagtgtgttgaactgaaattgaaaatgtcagggttagaccatgatcaaagtggtagtacctagaaaacgtactcagaaacataagttgttatctattttgaactacaaacttacaactgacataaagagaatcagatgcatgcatgcatcccttttctactttagaaaaactccaataaaagcaaatatccaacgagttgataaaaatcattttatatattttttccatactttcttttaagcttatatagttttcatacttgcttataatgccacgtcatttttactgctttaagaacaagtttaacataaattgctcacggaaaacaacttaataagtgcttttagtagcaagtttatcacattggggaggcaattaaggattgctgtgacgtcataacaccggttgctcggataagcaccagtttctatttaattttgtgcgtctctttcgacttttatgccaccatcaatctttgttggatacaactttgggatagcaccttttgtatttttttttgtgttatttttaactaaaattcgaattttaactcaaataactaatgtatttttttaagaactagtaatgtcgattattaatgtgacaatttttgtgtgatttaccatttcagtggaaaaaaaaaacgaagtgagttaccgaaataaaagcacataataaattatacgtaaatttatcctattttgtttctataatatactgtatggtaagaaatagaaaaaatgtataggaaatagaatacaaaaataataggaaatacttataaaaataacagtaaaaaatgtaaacagtaggaaaagggtccggaaataccaggagatgcaaattgcaaacggtcaaattagcacctgtaaaaataaagaaaaagtttttgcatccgatcaattatttcgaataaaaaattgacatgcatgtattttaatgaattttacaataatactttaaaagttatcctttaaaaaaaattattaattaataatgtaaaagtcaataaaattattataaggataactttaatgtattattgtaaaagaaaataaaataccatacatgtcaatttcttattagaaaaaaaaattgattggatgtatgaaaattaaactcatttttaaataccttaattcataacattttatatacaattttacgtcatacatttttcatcttcttgtatctatttattttctcaaattctcaactttatatttcctttattttcctaaggattgcatctcaatcaatataatctttttttttaaattagatgcaaaattctaaaccttcaatttataaaaaatcttccaatttcttcaaattcttttaactcggccataggaattttcctatgtttccattccataattcttttcacccagatatttgccaaataggaaatccatttggaatgtcaaaccaatgtggattgaatttttaatcacaacaactacccataacatctttggtggggtttcattgagtattagtggtgggaattgattcaatctacaatctcaaatactaattgatttcataaagaagtatgaagttccacctttaaagggtgatcatacaaattttaaaacaaaatttagaatgaatgaatttatttcttagtcaaacatgattgaatattataatatatattgatgaaaaacaaagggtgatcatacaaattctaaaacaagatatataatggatgaatatatttcttagtcaatagataattataaaagtaaacaaaaaaagttgttattggataagaatcaaaccagctaatgaacattgtaataatttagagagaaaggagtgattgcactaaaaaattatagacaacattacaaattcaaaaatttaagagtacaaataataagaagtcacaacaaagaaaaattacaattcgaaaatgatgtcataaataatacttgttttcttttatccacatgaatgaaagttattcaaatttgaatccacaaacggatctgaatttaaaaaaaaaaatctatttcgggatatttttaaaattctatttcatgatatgcacacatcatcctaaatttgctaaaaaaatatatgcgtttaaaatcctaagagaaacttagatattcatgataagttgttctcttattatctctaattagtaattactatttgagttactttttccattacttatgcaagagtaaccaccaatagactcacccttagagctcttactctcaataaagggttttagtgttaaattttcagccttccgtttaattacagagtaattaacagtacatcatgtagacaaaaaaaaaaatggaggtgtcgtttataaattttgataatgcatgagtcataattgtgaggataggaatttatgttcttagtatcatagcttaaacagggggttaaatttgattcttctacacaaaagatttaatgataaaataacaagttataattattaattacaaaattgacaataaagactataaataaatatatgcaaacatataaaaattattgtgattaaattacataattgtaagaagcttcgcctatattttaaactactcatttattaatcctgtatgggcaagttaggctaacctaggactgggaactatgctggttctgatccaaaaccaagcacacaaattaagcactttctgtcaactattcttttcgtggcaacagaaattactaacagtatgaaatgaaccttcgtgaatatgttatcatcaatcaatttttaattagtttgattgcaatctcccaagttttatacttgtacaattaatctgaagttatcatagtgggctttacttttgtcctttttgtaccttctttgcgcgtgtaaattttcacttatataatatgtttaacggacaactcgagattaagtgggcgactaaaaattaagtggacgaaaataaatttgttaaaaaattaaggagtttttggtgcagaaaattttaggggaaagaatatgttaggttcaagataaagaaaggtttctaggttaaaaaaacatttataaaaaattatatttagcacagtcaaaaagataagagaggattcaaacttataattacctaacaaatataaaattttatattaataagttgttggtataagatgattgaaaaaaaaatcataaaaaattataaatcagatttttaaataaaaattagtcatacacaaaggttgatgattactctatattagtaatataataacaaaaaaaaaatattaaaaaaaaattgttttgttttagtcgataaacttcttatgattaacatatatacatatatatatatatatataacaaacccatgtattaatttggtttactataaaactataattttatgaggaattgagggggagaaaagtagttgaccagaaagtgatggatggattacacattattagttattaaattggaatgtttgcacattttgcataaatttatgtcctcttgacctgccgactattagactatatcaccacagctcagggaagcaccttaattggttctgtagccaagaaagcgaaatgactttagcatggctatgaaataaaaatattcaacatttatctacattatctttatccttgcattggaccatgacaccatgtgactttatagaattgcactggattcatagagcctcaactaaatgcatcacttattattttagtgtgctaactttttctaatgaagtttcactttaaactaaagaataaagagaacaatgatggtattcctcccatgatccttatatgaaaattagattagtggtatcatcgccttaaaacaaatgggaattgtgtttcaaagtcaaagtcaactatctttaccaaacattatagtattgaccatcaaggattgtattggtgtttcttttttattatcaaatttttttatcaatatattggtggggtttaaactttaaaaacaaataatcgtatagaaacaggaggctaaattttttcataattttatttttctaaaagaaaaatcttgaagaggccttctctctaacataagtgtgtgtgttgaaaaaagatttcaaagtattatttaatcaattatataattaaaatattcgttacggtagaggcaattttatattatgtgatagtaatttttatattgtcaataatatattaattttatgaggcatttttgctgcaattttttttttttagtatttttcttttagagaaatattagtttcacacatttaattctattgacacatatcatcatcatattctttaaattggtcactatgtaattttttattattattattaagaaccaaaacgatggactcaaaaaggtccaaagtttcttttttttcaaaaatgtatccctgaaattaaagatagtaatagcatatgtcttgccaaagcatgaaactttcctcgttccccaaaacgtgaatccctatcaactatgtcctttatggtccattttgaaaagttagaagtaccaaagatgacagtggcaaaaacaaagtggaggcagagcattggttgcagcgatggagaagttgttgagtgtgttcgttcacgatctacgcttacgagttgaacctctttatggtgatcgacacactcctgtcaaacacaaaacactgcccaagggaagaggttgcactgagggtttaagggttaccatgaaagctgaggctgcagtattgggtagacaatgttttggttcttaataatgataaaacaaaatcaagaaaatataaagtcacaaaacttaaacaattggtgaacaggagattaattttcaaaatatgatgatttggtccaattaaaagaagtgtgcttcaaagagtgaatgagaatgtgacctaagatcgatccaagctaaaaatatgatgatttaggtccatcaaaaaaaatatttttattaatttttataaagcaaaaaatacctcatatttggacaaaatatatcataatattgacaaaaagaactaatatattatactattatttaaagtaaaaaaaaaaaaaaaactctttaaaattactttaaacatcattcattagatcaatcctaatcttagcatttctcactaataatagtctttggcacttgcttggtgcatcatccaaacattttagtgaatgtttaagaagtacttgatttcaataatagaaaagtcaatgtctttcattgatttgtaatgtatacattaaaaaaaatatagaaatagttgtacaataaaattggataacaactaaaagataaattcaattaatacggttaaaaagcaaagcctgtgacccaatgtacataaacagatttaaacaaattggattgggttcggcccaaataaaaaagtctaatcgggtgaaatcgaatttatgagcgaatcgtacggtgaacatcatattcttgatattctttttcaatgatcacacatttttatttttctctaaactagaattttcagtttaaagcaatcaaatatcagcttatctattttgtgagagattttctggattaatttcgcgcgccagaaaccctagaggaaccctgattcattcgattcgctgttgccttcgaatttcgttccttggaagattagggagcaatggcaattgcagccccagggcatctgaacgtgaatgaatcacccatttggggatccagaagtgttgattgcttcgagaaattggagcaaattggcgagggcacatatgggtttgtttcaatttctctactgcttaagctttacgttatcaaaaacaagtttttattttgggttgtctttgtgaaaaatgtagatgaaaatttatgaagtcaatggtaactattatacgtgtttactatgcaacactctattgggattattggagagattctgttgggctaggttgaacctgaaaacaacttaaacgtgaggtttttagaactcttgattctttatcatgtagctattatcaatcagaaaattttatcggtggagaaatcatcatagttatctattgttcgatgcattgaggtttaattgttttgtatatcttttttttaaaaaaaaaattattatttattggttccaaggttttaaattgcattcatgtttaatggcgatcattgatattgtgggaaattatagacatatgtggctaatgcagctgcaattgtggttgtgaacttgtgatgtggttgcagagacccctaaaacctcggtgttgtggctgcaattgcagttacgagctgtttttaaaaaccttgattggttctttatggtttatttgactgtttgtgcaattttttttttattgtcttatgttagttgttagtttcctcaattaacttgggttaaagatgctattgatatcgatcttgatgttagttgttagtttgttagtttttgttagcaggagattcgaacccacgacctctccccctcccttctcccttccccaccaaaccaaccttatatcttcatcttgtgcaatttggtgtcttgtgttcccttgtctcttgtctgtttttgaagtagtactttttgccacattgctttcttctttggacatagttcccaactccatcacacctttaaaatgtcatctagttttagctttgttcatagcaatgcaattttcccccctttatgttccttaagctcttgttttgactttacagtcagagaaaaaaaaaaacttgttcccacttcattgctgatactttctcaagtgaactgatgtataccttaatatatttatgcttgcagtcaggtttacatggctaaagagatcaaaactggtgaaattgttgctctgaagaaaatacgaatggacaatgagagagagggggtatatctttgatttgaatatttcattatttattacattatgggtgcataatgtattttatttgtgttttcctccaattgtacgctttcctaattagtctcctctgcttttacaaccttttttcattgtacatgctattcagtgaacctaaatcggaagttacagttaaaatctgttgctacagttgctcctctgaactgtattgtaaattttgccattgcagtttcctataactgctatacgagaaatcaaaattctaaagaaactacaccatgaaaatgtgatcaagctgaaggaaattgtgactgatacaggtaccctttttcaagatttaggatttaaaaatttgttttatatataaaattgggttatttctttcaggtcctgagaaagatgaacaggggaagccaggcaagtaattccttctcgtttaattagccaatttctagacagtaacacataatatgctttatagttctagtggtgagaatatttccatgattccatcaatttcttttgggctttgcatactaaacttagttcatctgcttttcattctttttttggggattgcagatggtaacaaatataaaggtggcatctatatggtctttgaatacatggaccatgatttaacaggtcttgctgaccggcctgggatgagatttacagttccccaaattaaggtattactgttaataccaagtgttatttcatatattaatagttgttcgttttattgttgtctgagttgtgtttcccttcttaagtgttacatgagacagcttttgacggggcttcactattgtcatgtaaatcaagtacttcatcgggatatcaaaggtctgtgtgttaaaagattatgtttttacattagaatgttaaatctattattattcctatttgatgtattttattctggtgcaggctcaaatcttctaatagacaatgaaggaaatcttaagcttgcagattttggactggcacgatcattttctaatgaccaaaatgcaaatcttactaatcgtgtcattacgttatggtacaggtaattggtgtcatttttttatcatgagttatcaaattggccaatgcatatattgatttttggctatatttagaccacctgagttgctgctaggaacaacaaagtatgggccagctgtggatatgtggtctgttgggtgcatttttgctgagcttcttcaagggaagcctatctttcctggaaaagatgaggtaagtgatgttttatgtatgatagttcagagaaattagagctagattgatgaatgattggtgtgatattgattatgggctatatatggttttaacttttatcttgtaaatggctgcaagaagatattctctacattctgactcttcatattcgatctcttgacacttgctgccatatttattttactgcatattgtaaacatatctgagcctagttgccacgacccacgagcataaaataatctttctgttttcatttaaatggctttacattgattgctttcttcgggtgccaagctaattaattgtttaacttggaaaatgtcatttcattcaggaggtcaatgatgtttatgtattttgattttgaatatatgcattttgcttaattaatttttggttaaattaaaattttagtcctcatgagtgacactgtttttcattgtagtccctgtaagaattctatgttttggtccataatctctaatattttcaaattggtttctgtcgtttgctaaagttaatacagtgttagagattttttatgtagggagtagggaccaaaacgaaaaatggtgtgtcaggtgtagagatcaaaatgtagtttttttttttttcatataggaaccaagacaaagtgtaatttatttatttttggtataagaacaaacaaaaaacagtgtctagtataggttccaaatttaatacttgattaaatagcagggtttcatttgtaaacatttttcatgtaggaaccaaaatgtagagtttttccatgcagaaactaaaatgaaaaacagtgttaggtgtggggacaatttttatatttaattgtcaagaaaagatggaatgttaatgtttgggtacattgctggatcaaacctgctgtatagttttcagttatttagtcattacattcactctagatctttctgttaatatacatggcattactgtatatattcacgataatttttcgtacagcttaagtgtaatacaggttttgtttgtaactattgtagccagaacaattaaataaaatatatgagctgtgtggagcaccaaatgaagtcaattggcctggggtttccaagataccttattataataaatttatgccaacaaggccgatgaaaagacgtttgagggaagttttcaggcagtaagtatcaaaacaagagtatcagaaagtatataggcttttttatccaccaaagaagttagcgtgtaattcattttctagaaaaaaaattatatctaatagcttcttccccatgacttatagttttgatcatcatgctctggaattgttggagaagatgttgacacttgatccagctcaggtatcacttcttcacttataagtctgatttattaattgttaaatgatattgaatttctattttaagtgcttcaaatacctgtttttccagttttatcttttatcattcaatctgttttaacttggttaactgtatccacaattgttttgttattaattatatcatatatgttgacaaaaatctcagtaagcttaagagaaaaatattgtacatctgttttcctttgtgagaaatttatgtaaggtgaacattgatggcatagtgctagttgagacgaattttgttaagtaattatctttgtgctgtcatttataaatttgtgttgttcttggtgtaatctgaaaatttattgtaacaaaaataattattaaatttataaatgtaaccaagaaaattattatttgtcacttggctgcatggttttatgatgattaattttgttttatgatctgcatcataatatttgtttgtccattttatttctacagagaattactgcaaaagatgcacttgatgctgagtatttctggacagatccattaccgtgcgatccgaagaggttagaccttccatgtacattagttatttattttgagaatgttactttgaaattatgtgatcttaaaaggattaaatgtctgtctcattgattcctttcctttttacattattgtttctactcaactaatccttttctggtcaatacttttcaacttcgttctcttctgtatggcttagtttacccaagtacgaatcatcacatgagtttcagacaaagaaaaagcgacaacaacaacggcaaaatgaagaaatggctaagcgtcagaaaatgccgcacccacagcctcacactcgtcttccccccattcagcagcctgggcaacatgcccaaatgcgatcaggaccaaaccaaccagttcatggttctcaaccccaagttgctgcaggacctacgcatcattatgggaagccccggggtccatctggtgggcctggaagatatcctcccaatgggaacccaggtggaggattcaatcacccaaatcgaggaggtcaaggtggtggtggttatggcagtggatcttatcctcctcaagggcggggggcgccttatgggtccaatagtatgcctggtggtggtcctcgtggcggtggtgccagcggctatgttggagctccaaattatccccaacaaggtggtccatatgggggctcagcggctggtcgtggctcgaacatgatgggtggaaaccgcaatcaacaacagtatggttggcagcagtaaatatacttatgatgatcagtattagtactacaatttggcaataccctgctaaatttgagaaggaccagactatttatggatcaaggtactgagaagatatgagatatgacctctatggtttgtatactactgagatattcgttctcattacttgaagtgcttggaaacttttgtgatgcatgcatgcaccttaggtaatgtttggggctccttattacaagggcactacaagagaagagtgaacctccgattttgtagtttttttctttttcttgactatatacattgattcctgtgcagtatgtatgaatgttagcagcatacttcaaaatgtgtaacaagctgctgcttactgatattcttattgggatactgccttgcacaatattttgttttatgtagttttacactatagtatgatatgcactgtatatatggttatggtagtggtagggaagtgaaattaatgaatatgggtacgagagattatggaagacaaaacaaacaaattgcacacaggcagaagtggggaggagtgtaacatgtggatgtggttcaaggagagaaaataacaggtggcaaggagagagagggagaggagagagggggttatatgatgggtgtgataaccgaataggaggtatgaggaaattgtaagaatgagtgaagaagctagttctctaatttgttatttatttttctatttgtaaggagctagtctccaaccgctaccctagttttatttctttaaattttcttaaattgcagcattgtaagttgtaacagactaaaccgaggtttatatttgtagagttacctttaccatttatattctggttcccaacacagtaaaacaaaacattctgctttgtaacttattgttccctttatgatatggtgaccgaaaatattcaacgattaagcctagagcaaattttgcttcctatatatattgagacttttctgcaagcttctaaacgttcttatctccatagcgatgtattgtgatcatcagtggtttttattaacttttttcttttggttgctatgcaagtgatgatagaaggaatataagagggatcattgccataggaaaatgtaatggatccaacagaaattactaaacattttattatacttgtttttgtctttcttcataaacattaacggaaacataggaagattcattcataaagattaagaaaaaaggaggataaaaaaaatccaaaggaactaacaatggttttgttttagagaaaactaataatgtttgaactaatgtcttcgtctaaaatagagatatcataagtaaagtttgtctaaacctcttaaggttacttttacgtcaaccaagcattgtttaatgagatgtctgagtaaattttaaacattttagagaaacttacaactcattttggagagatgatgattaatatgaaggaaaaattatgtgattttacatggatatgaatacaacggtgcaaaagttacaagttttggtttttctaactatatacccttttggactcctaacaaaacattaccgtttcacatttgaaacaattcatatgatatcacatgaataatgccccgttgtttaagcatggtaatgctttccgacaatgacccgaaaataaaataatgctttgccctagatgaaaattattcacttagtcgcaaaactgaaagaacaaagcacttgttgtgatgcaaaagcattagtccacatagagaaagaacagctcatagtttgttactactacttgtagctgacgtctgggaatgactagaatgctttgttgtatgattctcagttccagattttggggtccttgggaatgaatttgtggaatgtagtgcttccaattctgctagaacagttaccatagttggtctatatttgggatcagaatttagacattgtagtacaagtgctcctgcagcccgtgctcctttcttggagtattgaccacccaaccttgaatccatgattctcaaaattcttttgctatcactcaagaatggccttgcccaatccaccagtgtttcttctgaaaatccaggtctatcatcttcaactacacgctgtcctgttagtaattctaacaacacaactccaaagctgtatacatcacttcttggggtcaaatgacctgtttgtttattcaaaaagcaacttattataaatgggaaaaatatatgctcatcaactttacaaaccatgtcaactttacaaatcatgtacataacatcacagcaaatgtaacattatttagtttttgtctcttatgtgtagagtactctagagttttgaagaaataaaccgatttgctttgtgttttctttttatatatataataacatatatagctatgtctggatcaccgttcaccccttttaaaagtacgttcaaataaagagcatcattctccaaaagtatgttcaacacccaaaagtaggtccgaaatggttatccaaacattcaaaatgttggccaatttgataacttcattttgagctgtgacctctaagaagaagttacagacaagttacctagggttgtgtttggattagcgttgaaaccacgtcaaatggagaaattgcacattccaatgcaaaaacttcaaagcaacaaagttgtactagctttcatgtgaaagtctgttggcgttgaattcaagtattcaactgattcccaatcacacactaggtctcttataccaaggactaagaaattagtgtagtgaactaggatgcattcaaattggtgtccaaatgaatttttagaattaaaaaaagtcacaagtgtccattattagtataacacagcatcattgcatcttcctttgtctcaattgctccttgcttttattttgcttctaccttaacatccaaaagctaagaaactaacactttgataaagataaagaaaaatggaaaggcaaatctacctgtagctacatactcaggtgcagcataaccatgagtaccaataactcttgttgaaacatgagtgttatctccagtaggaccatctcttgctaagccaaaatccgaaagctttgcattgaaatcctgcataaataataatgctactctttcagaatggagatttacatgcaaaacagcacgtgtggttttcttcacaaatccacaagccaaactttcagtgtgacataccgaatcaagtaggatgttcgcagcctttaaatcacgatatataacatttgcatcaagggtatgtaaaaatgttaatcctcttgcgacagcaactgcaatgttgatccgtgtaatccaaggaataggttgaacaccttctgcagtaatagaaaacaaaatttgaggtattgtgaataaagaaaaattatggttcagggcattgtcaagcctgtcccgtatattaaaaggttaggtttagactttataaaaagtctgttttagtgaaaagatcaagttccaggctttaaagaaacctctgataagtcggtctatttataaacataataatattatattatattattacattatatataaataatacataattcattatacatatactacaaattgcacctaataaaaatataaaatcattattattaaaattgatttttttgaaggacttttaggcttacaagtcaaacagactttgtaattataaaccagatcgggctcaggcctaccatagccaactctggcctaccctatttccacccatttgtacactagtactcagtggatcatttgagactagatatgttgattgttgaagagtgaatgtactacttacttctgaataaatgattttccaaacttcctttctgcataaactcataaactagaagcctgtttttaccatctgtgcagtaaccaataagtttcaccatattttcgtggtgaagctggcctagataattgacttctgcctgcaaacaaaaagggaagaaaattagtcaacacctagcaagaccaagcagttagaaaacagtttaagagtttgtgttggacttggacatacaagccattctctgtggccttgaaagctttctggtttaagtttcttgatggccactacaattccagtccctggttttgttggagcgcatgtgttctcatctatccatcccttgtagacaaacccaaaccctccttctccaattaagttttcttgcctgaagttcttagtggcctctcttagatcattgaaggtgaaggacttaaggctattggaaatgggattgtcaacatttgatgatgatgtttttaaaggagcttttcgttcagaagaatttgagttctgttttctcttactctgacactttgtgcttcctgagagtagatgatatgcaagttacaatcagccattggagtaacttctaaaacctagtgcagaagattgcactattatgtgtagcatctagaagttgattactagctatgaggtgctaaaagagtgattgattgagcatgcatatatagacatcaagtgttagagtgaatcattggtttttgccacactgcatgcacaaaatataagaacaataatgaaaaacaaccaaaggctattagaattccaaaaaaacatataatgaattgaaagtttttttgctgaacgaatttcatcattgaactaaccccctttacattattctcgatagacaagaattgttttaaacaagcaaaggggaagggagatgttatacaaacatccagtaacatacaattagctcattcggagcaccagtgccttattgttgaaaagaaagaaaaaatagccaaaggaaaatgcagctaatttcaatccacatactagcaactgcattaacagaaaaaagcaaaaattattcaacattatttagaacctgattcagagcgacgaagcctcataatctccattttttcaggccaatattaacacaatacagaaggtttatatataaattactcaaaatacaaaaatttaattcaatcctaggaagccaaggacttgagaacaataaacaaacaagaaaacaaaagaaggtcaattcaagactagctagtcctataatctttcacgttacaacctatgaactattgttttaacctttaccattttgagaacatcgccttcttcttctctccgtggataccaaagagagaaaaataaaatcatccaatataacaaaccgtaatcatatttaaggcatcatcatcatcaacctaagtggcatgaccagtgctaactgatgataacagaaaagttgaagaaaaacaattgaaggctttatactttgtactaaaaaagataaattagaaaaagtgatatagtcatatatatatggttaaagtaaccaaattaaaactgaccaaagaaacttgctgaagacacatgagccactggttttctgcaggagtttcccatgatgaaagttttttctttttctttctcaggccaaaacagcaccaatggtgacaagggtgtgaatgaaatgaaaaatttctccaaaattgtaagtatttgtctgtctgggaagaagtaagaagaaaatgtcaagtgtatggcctttagataaagaagtgaagcaaggggtaactaaggaaatagcgtagtcaattgttattcattgaaccaatgtaaacataactgttttgttcacgttgactcttcaaagattgaaggaagtgccaagtgccccaaaccaggctctaaaatctaaaatcctacctgcttttattaagtattggtaagattttgactcttatgttcatgcacacgacaacttccttaatgcgtgaattgccaacgtgacgttgaaagttggaaaaagaatgtcatctagtaaatggtaatatttcatttgacagcaatggtataattttttctaacatactcaatatacacacatttgtgttacttgggttagttaaaacttaataaaaacaatgatgaaattgtgtaagtataattcctttttctatggttagtctctaataattttttactagtttccacataaaaataataataattaaaaagaacatcacaaaatatattgttaggctttatatttaatagccaacttcccaacaacctgacacgccaaggcactattattgttattattagtatggaaaatttcaaaggtttaatttgttgtcatatcaatgacactgtatcttaaatttgtcttgaaggcatatttattacttgtattactactttcataactagtttcacaacataatacaaatcatcaaaataaaagaaaatgatgattacatttaacattattataaaattaaattttattttaaaagtgatcttaaatttaaatattataaataatgattttatttaatattaatattcatagtctaatgagtggatatttaataaataaaattaatcataaattaaatatataaaagatatttaactttaaataagtttaagaattgatcattcttacttataattaataacaaagaaaaatattatttattatttatatatgagatcataggtagtattttcttatcctaaattaaaaataatttttactgtcccaaaataagtattgtcttgtactattttatatagataataataataataataaataaatgaaatagagtaataattttaaaaaactaattttattaaataaataaaagtagtgttaatattaaatttaaaaactaaaatgatatttattagggatattgataaaaaaaattataatgaaaagttaaatataacatctattttgggataattattttttcaaatgggatatttattttggaaccgatgatttaatgtcttgcctatgaatattatatattttatttgtcatgttctatctaatttcatctgatttgttatgttgttgtgataagtgtttttttattttaaattatttgatgaactttatcatgtaacttgacgtgaggtatatatcaatggttgataatttctccctgagtgttttctgtgactcttttgtcacagtttaactttcttggtcaaatatttctcatttcattaccgtgtggtgtctttcgatgaccgcgatatataatgatcccccactaaataatggtcccctattaaatgaggataaggatttttcttttttctttcttctttcttctttctttttcttaaatcgagagtcatgtgaacatggttacatatggacgaaggaattagacttatgtccctcgtttttttttttaattttcaaatcaatcgggattcaaagtgccattaaaccatctttagttgcatatccaaattaaacctttttagtccaacaacaaggaatgaacatgaagtttggaaaaattcaagattgcatgcatattcaaagtaacatttgggtgacgagaactttctatcagttgttgattccatataagaaagaattcgtacgtataatcaaattgtaagaagtttcatctaacctctttgaatttacacatgtctctcttttaacttttaagataaataatgggaaaaaaaaaactaccaataccatattctttaacgtaactatatgtattaaatattattctctttggtctcatacatgaggaaaaaaaatcttatctgtttaacatgaatataaataaatctaaccagttttattatatttaatattatcattctttaaatactttttatttaattctaattttattttcaatgatttgtttttattcatgataataaatttcaatgaaaaacattttagaaataattattttttatttaagattaataaaattaaataaggtcaaccaactttcttaatttgtgtaaatttaattatctttttcttatatatgagtgtagaagaagtaaattttaggtggatatcactaaaaaacttgattacacaaattattagtctatttagtaagattcatatacatttgtacttcgactgcggtattaattcaccatgctttatgaaccctctccaactagcattagtacctttcctaagaaaaatgccaagtttttcccacaaatatttggttcttagtttggggacagcatattctcttgtgggaatagcgtgtccgcatagaggcaagcaaggaatgtgacgatagttatgtttgaaagtaattaagtaaacaaaattaaaacactaaccagtatcctaaaaaaatggttaagatatttaaaacaaaaatatcttattaaaagatgaaaaattatgttattcatatttttttacgtttttttatgatttatataataattttttttttatttctttaactaatactctaaaggtattggttaataaaacccttaattaaatccgttagtttttgtggaaagaaaaatattaatcaatattcttaaggtattagttaaggaaaaaaatatttataactttttttatatattttttataattttcacaatattttttttaattctttactcaatgttataaaggcatttagttaacaacaccttgtagaaaaggtttaaaaaagaaaagtgtttccggagacagcatcaagccatgaaaaagaaagcatgttacattgttatgtggatggtagacaccatgtatagagggggggaaattttgaatttggtataaacagtacttaattttcaagaggatgaataattaatgaagaacgtgtcatactttgacttcatctctaaaccgtcttagaagaagctctagtactctcaacccattgttagtttctcgtttaattcatcatcaaaaaagtagcatgggcattcttatttgcaatgttgaattgaactagtcccttcccatctacaaatggaaaatgaacgtgaaatgactaagcatttatgtatacaagaaaatagtgtattcggtgtccaatttcttttaatgtccaaaatttaaattattttgagacaaagacaatgttacgtacattttacttgtgctgactttaactattctttctttaattatttaatgtaattacatgtccaaaatttaaattatatctgactttaactccctgaatttttttggtttgtgttgaataaggttagaataaaatcataagatattcattttgtagaataaaatcataaggccggcagttcatttgttttaattacctaatcaacacttttattttataagcttaccaaatcaacacttgacctgttcttgaccgtttgacctaccaattagtttcctctttgatataggagagtgattttatattcaattaccaaaaatagctagcccttgaaatacgtgaggttaacaagattgtagaagagacaataaaacttttttctccaaatgaaattgctaaagtgacgtcgagggtggcttcattggattattataaatatatgaattttaatcttttttatctaatttctatttgtttatcatataacttaaaatatctattattttctctatctctatttacgtttaacatttttcgacttcatcaaccaatgatccaattgtcaaaaaggcgtgtaatcttgtggcataatttgacactgaaaatgggacaggttttacattaccaaatgaaataaaattgatcgatgaggataacatgttcattcagtaaacagaggctataattacgtagtctttttggttacaaattacgttttgtttttggtcggcaagatggttacaaattaagtagtcttcttttatcaatgtggcatgaaattattgcaaagaacattgtataatagaagttctacaattagaatatccgaatatcagaatatgtatgtacctaggaaaataccacaatagtgattccagtgaattgataaagtaaattaatctcattatcaatgagattggctcgctgattttgaagttcacattttagcttattactaagaatgctaacaagtactttcaggataatactaaaagaattgaatgtgaaaacatgttattacttcccaatacacacactgatttttatcgtaactttatcctaattctcaataaaaattgaattgaattaaaatatattgaaaatataaaaaaatattacatattatctaatcatatatcattatttatgataattttattgacttatataaaataattattttaaaaattatatttaggatgatatctaataagttgatagtcagactcagagcacttcaaagaacaaaaggcccagaacacaacactacacggcaaggcccacattccactcatgtccataacctattatagagcatagattttcgaaaatagagcataaaatctctcactttttggaattcacactctgcttcagcatgtaaatgaattaaaatgcaaaagagtaatggaatgttgaattaaaaaaaaaaaaaagtgaaattaagatagaccagaatgtaaaagaagtgtagaaaactgaaaaagggtgtgaaagaatcattccgcaaccatcatacatacacccaaacccaatagcatcatgttgtccatactttttgtatgggcactcgtttgcactcgtttgaaaccaataaacttgtgctataaaaattttaaggcacgtttaacattttcctttatcccatagtttagctcggctcatttggttaaataaaatatatgagttattataaattttctcataacgtcttcaattcatactactataaaaagattaattgcctcacatacaggaaattgaatgcatattaatatgggaactttcccgtaaaattcaatgatgaataattgatgcatcttgcaccacctcgaccacatcaataaataatattaattatgtaactcgtccaatattaagtgttgtcctatttttattttacacaaatttttaaaaataaaaaatgtataacaaatttataaaacgaactttactattattttatctttaaatatctacgacatcatttctctactccacagtttcattttcaaaggaattaatttatttttttgctaaaaatgatgtaacacaacattatttaaactaataaaaaagtaacacatcattattttttttttgttggccattgtatttctccactgagaatcaatgaaaaattcttcaaaatactaaaattcatttaaaaaagtaacatcttttaatatatatttgttcatatgcacaaaaccagaaataaactcctaaccatgtcacaccaaataatctcttgagttccagaccagaccaaatttgaaaactgaattctacccttataccacaagcccacttccttttgttttttttccccaggggaatatggaatattcttcggttcttaatttcttgcatgtgagaacaagtatatcaaattgtttaccaattagtcctctcttaaaatatttttagtgatagatcttaaattaagattttatattattttttggtagacttcttagtattacataggattaaagatttctttcatttttcttctttaatgatatatcttattttaagattttaggatgagagaaaaatgaaaaaaatttattcttttttgaataatatgaagattttaaggaatttttttataaaaactcattctctgtattagaaatctttctaactcctttattaagagatttagaaaaaattagatcttaaattcaagatcttgtactaaaaatactattagtaatataaaagtcaagcacaattcaaaatgaaattccctatatgccgaaacagataatggttgacgaaaatgtacgtatattgttttttaatgttattcatgcacatctttgattaattagacaagccaaacgaacggtcccaaagttgcacggaaaacaactccagatcgagaagcagttcagtggtccaatgaaaaaccgtacatctatttcaatttctttaaaataaattgcacatataacttttctataattaagttctcatttttataaagacatcttcaaaccacatgtcccaaacgtaaccacataaaccatcaatgggagacaaataaatcttctaattgaaaaattctcacaactttaaaatgaattttaacttgtcctccaatttttgtcttaatttacaccgtaaaaattggactggttatccaattgaaaactagacattcaactaggagtgttcgtatattgattgattggttagtttagatttagcgtaaaatcaagtttgaaccgataatatttaattgacttaacttgattcgaattttgaaagaaaaaaaatgggtcaatcaaatcatattaaacagattaaatattactctagttaatttatacaataataatctctcgaggtgcttattttatgtcattaaagctacaaatcagtgtgtagatgattttgtttgcatcatcgagttatgataatatatatatatatatatatatatataatgtttttaatattttatatatacttattgtcttttttttgtgccatgaatatatgattgcatcatatcatcaagaaaaatatatgattcttttttaaaaataattttaattaccttttttattttaaaataccagagagctaaatataagaaaaatcgattatctcatataacttcccgataataatattataaatcattttaaaattaataaaaaaatcaatttgattctaaatattagacgatgcaaagaattttgaagctgtagttcgactttctccctaaatttatatcatttaaatttgacaaaactagtttgtaattattttaaccaatgagtttaacttgatagtattgctcagaagaagaaaaaaagtgatagtattattatttataaaaattagaagaaacaaaaaaacaaccattcttcaagtaaaagcctccaaaaaaatgtaaaatgaaaaaaaaaatgtaagttcactaatagatgagttatatatgattcaccattaagcacgttaaagacctgaatatacaatagagttaaattaaatatttagatggagaaccttactcccataatggttttaacaattatatgctcgaatagaattaatctctccagtacaaaatacatgtgtactgtagtttagataaaaaaaagactaatcaatgtatacctaaaaaaaactactcaatgtaacttagatacaaattataattaaaatgtagatgaattaaagtaggaaggaaagaagtgcaaaaatttatttttgctcttttaattaaataaatggaatagagaatgaaaaataaataaattatataaaaatattttatattaattaaaattaactagaaaatgaaaaagagaaagactattcctctctcatttaatgccaatttaaaataaaattattttgtggtgagtcctatcaaaataactttcctcctttgtatctcttcccttaaatttagtttttttttcttcttcttatttccactttaattatttacacccaaactgcaacaacattatgctggctctaggtgtacgaagagtttgttagatctgatctatttgtataggtctgcatgcatgatatatctagaagaggatagtctctatcaatgcatggatcttacatatatattattttgaaacataatctaaaattccggaaacagtgaaatttatgctaaatttactttgttcttatattatctttacatgataataacgatgtgttatatcttatatgtacgtaagacacaatatttaattaaaccctaaatctaagaggccggttttgatattttttgtaagacatgaagttgttctataataagcaatctgcacaattttgtaaaccctggtacagtgtttaggctttgctctttttctgaatttttggtaaggagttgataggaacatggccattattttcactcacgtgtctgggacccaacaattagtgcagctgtcgtgtgagagccaatattagtggacatcgtgtaaaatagattggctgttagatgcagtcattagatgattgttcgatattattgcatttattaggatttgtacttggttgttgcagtatatagcactagtctcacgagatttactgtataatgtttttttttttctctcgtacggttagtgggtttttttattataaaatctttttaaaaaattatttatctatttatttatttatagattttttttcaatttttagatatattaagtattttttacatattcttgattattttctctccaaaattaatgataaatataattaagtgaatagaaagataagaaaataattattattttttaaaagacatgaattaattaaagggattttataattaggaaaaaatatttattttcgttgaaattggttggttagttaatttgtgctgattgttattattactactaaaaactctataaatagcgtgtaaacattcattttacatgctatttattcaattatgagcatgtttgaaaattcgatgaaaagtgttttttgagacaaaaatattttaaaaaaaaaattgtttttatttttatttatttttatccattgaattttgttaaaacatgcatcaacaatttcaactataaatcaaatgtatgtagatgcactacatagttgattttgatgatataggacttagttttagttgaaactagctcgttaacaggttgttaaactggttttggatgttgcttcaatatttgacaatctatttttgtagttgttgtataaacaagtggaacctgaaaacttacatctttagtatgtccatctgaagtgagctcaaattgagttgttttatcatcttgcttgtgttaattatgatatatataaaaaaattcacagacgacaccaagtcaccaattatactctaagatggattgtactaacgtgttcaagatggacgactaactatgactctgaactttggtgagtgttgactgaggttgacttctacgtagactgaagttcaagagctttagatggtggtaattaagctctaaaatatagttaattaagatattgtgtaagtgaataattacttgtaaaaatactttaaaacttaattaagttattgaatattataccagagcaactctacgtaataaaataataaatacttatatgtcataatgacgttggtttatttataagaatttgagattgtctatattctacggcacaaaacccaaggcctcatgtgagcaataagactctttcttggcatagcaacattataactttgcttcaaactaatgtgtaatttgtgattcgcgaaatgtatattagaaggcctatacttgatgttaacttcgactcttacaatttgaattaatccaacatagaccaaagtagatcattatgtaaattgaaccttaaccgtaatccaaaacagggaaaaaccaatttttgaaaaaaacttcataatcgtaataatatttaaaaaggtaatcttataatgcacaatatagtaataacttctataaaaaaacatattaatagctgttagtaatctgtccaaaaaaattaactgttactatatagatgaactcattcaattattgaaaaattagtaattgtatgtattttgattaagacaaaccaataatgttacatattcttaaagaattctctaatgcccataatttaaaattaaaaaacaaatagtgtcaccgctttataaaaagataccaattcattagattgtaaatatgacctcatttccccaatatcaataatattatgaatttgcaaaacaacaataatgcaggagactcctatttaatatattagtgctagcaatatagcattgtcgttcgtccatacaagtctcagtcattaacaaaaaatatatataaaaatctcagtcactgaagaggtcaatttaatacgagtgttagtggggaacggtgtgagaagtgcaagttcggtttcaatcaccaatttttcaacaagctacaataaatttaaaaaattaattttaaattattttagctcggtttttaatttttatatttataacaaatattgactgtactttacatttaaaaatatttacttttttttaataatttttataaaataataagaaatttgtaagaagacatatcattatttattaaaaaataacacgtgactcaacgaggaaagaaaaataatgataataatcacttgaaagatgcatttcattttaataataagtgtgctaattagccacgctaacagcgatatatagaaccttcctagttcctaagcaattggagaagagagaaactttaaagtatttgatttgagaatagaactttcaaaaactgaagtatatataatttaaattcagaattaatatttcaaatcgaatctaataatacgtatcaaaaaagttgatattgtcctttactttcaaaaactcatttaccttaagatcaaaatttaatctgtgatgatataatttaatttatgccttattattgagcatatgaattaattgactgagatttttttttagacaaaatagactgagagttatattagcttaatcattcctctcgaataagcatatcgtgttgttttgtttagtagttgttcttgagcttttattttccatgcttctcattttgagaagtttttgtgaggattttttgaggttactatatgtaaacatgatgtgtatcctctgataaggttttggaacacaccttgtcggtcaaatcttttaataaaatttgcctttaaaaataaaacaattattctcccacacgaatggaaaattttgaatttctagagacgtaaacaaacttttcttttactggttccaagttctaacttctattggagcctggcttccaaattgtattgctgatggctctaaaccattaggattcggcttttctaaattgaaagaagtaattttatttgttgaataaaaaacaattattgattttaatgtatgtatataataaatcacaaatatattataatattcaccattaattttcttatcaacgactgaaattacatattttatctttcataattttagaaaagtcaaatctaaactattaattgattgattaggggttgtaatatttgaacccactttaatcatgtatttatatttttatttgatataataacatttttttagatacaaaggattaacttttaatatatttttatttcatgtgaatatagaagcgttcgatataagttcttcttcaaaaatctgacccctcttttttttaaaaaaatgtgtcattgtgttaaaaaaaaaaacgtttaaggtctctaataaattattgattttttttaacttttgataaaaaaaattattattttaaattcctaacatattaaattttttgttaagtccttgtcatcagattaaatgatgatgtgataccatcaaaatcattaataatattaagaaattcagtctataaaataacacatcatcacttaattaataataaaaaattaaaataaaagttttaatatatcaaaaatttgaaataacaaaaaaaattattaaaaattcaataacaaaatttgataattgaccagcaactttaaacatatttaaatcttaaaaaaatatcttcttatttccaaatctcataaataaatcattaaaagaagacaatttaacagcattctttttaagaaattaaagaaaaaatgcatgtcaccctaatctatcaaaaaattgtttcatacgtttagtatttcaaaccattttcaagagactcatacgaggtggatcgatctcctaagttcgcataagatgcaataagtacataaacgcttaaccttatatattaaaatcacgaaaacagatctcgaagtttttattattttttattaaatcaagggtagaggatgtgacgacgcgaccatgggcaatcgagtatcagcaaaaattcttgacgtaatggttgcatggattcaatagtcatagtgtttttttttttttccttaatcataaaatatagtttgttgtattatattacaaattaatttgcacgtgaaatagattgtcataaaaatttctgttgactagtaagtagtaacttatgtaaaataatttttgaagtagtcaacttttgaaaaaatttatagacaataatttgtgatcaaaacagtataaaatatctttatatttttaattagtatattttaattaaattattctacaaaatattacttgcattaataaactttgcatagtacctgggataaattatttttaattcttctctatcaatattcaactaattaatattacttgtattattaaacttcagatcgtatcacgttggggtggaaatgggatgtaagccttatataagatgaataaaacttaagatacattaaatatattcaaagtattttttttggtggtcatatatatttttaagtattaattttgaatcaaaatcaatatttcatttaataaaaaatttattttaattaatgagataaaaaaataattatcaaaataaatatcattttaaataaaaagttagtaccaataatatttattgtatcgtatctatatttatcgagacttaatgcgatgcactgttaaagctcacgtagtcacggtacatcttgtaaattttattccttcgagttggaggtatatgcacctatatttataattttggttacaattttcttgatcaagcattcgatatattttcaaaaagaatatattttaattttatccgacttttttttttgtgacaactacacattctaattttgcattttttttcgtgtcttcaaaataattttctgaagtaaatatttgatacattttcgtgagagtgcaagagagagtagagccaccgtccaacttcttcgatcccatggtggccccattgtttttttttttttttatgtaacttttttctaataatttgttaagatatgttagatcttgaacttaattgtctatattttatttatcttgatggcagatcttgcatacttgctgttcttttcatgtgcttgttttggttaatttatttttaatttatcttctattattttttttaacagaagttgacatatgttcctgccaaacagtggctgggcactatgctccttagtcgtactccttgtttttattcgtctcttattccagtgttcggtatattccggatagtaaatgctaattgtacagtgatcttcatatggaggatcttaactttataaatattcaaaacttttttattttatcaataagttattaatttgaatggtattagatttgatctttttaaataaggtcttgaatttgagtcttgtaaattaatgaaaaaaaaacgtaatttgaaaggaaaaaatctcattaaaaatgattaatcaaatttttcaacaaaaattaataactcataaaaataataaatactctgtatgtaccaataccctaattaaataaattaaaaccttcttgggccttcaagaacaaattaccatttagtttacctctaagcattattaaagggtctaacctcttgctgcctctaattaaggtcattttagccttatagagagccgtacaggtgttcgactagagtaactgaacatctatatatccagtataacatgtctgattgagtttaatttctgcttacactagttatgatttgggttatcttcttatattttctttttattcacatatgatattaaattattgttgaggttaatgatatttagtgactttacaaaggaataagtcttcccctaatttaaactgtctgtaaaattaaaaaaaaaatggaaaaatcaagatgatcttagaagtaagagaaattttagatatactttaagttgccaaacgaagaactatggcagaataaagagctatttccttgttcttcaaaggaggaagattccaatttcccttcttctacttattggtgtgccaacgcatggaaagaaagaaacaaattaaaactgactcaagttaccacgaaatgaccccacccccattaaagttaaagtgttaaacgcatgcagtgacaggcgcaatagaactttggtttggatgaactttcgatcttattaaagcattcactatggaacctttaccacacgaatgggacaagctattgaatgagttgtgggagaagggaagcagggaaaaatggctgaccaagaaattaagagataaccatgcatggctatgacttggttaagggaatcatagtttaacatacttatggttaattagcataaaacattattcatttgtttgggacaaatgtcaaaagaaaaaaaaaaaaacgtaagaaagtatataaatatttttttatcaacaaatattaatgattagtttttgttacttgaagagattgaagatgattttttttttccttttttcttaatcatttgacccattttatatctctatttaagaaagtatataaaggtggcccatcactgttttgatctttccattttgaagagaaaggaggaaaaaaatcatttttgtatgattataataccaaactattatatttacacacttttttttattaagaatatatatttattccagagtatataatatatattttctttccttctattttttatgcaatcaaataagaaaaaagaagaaatttatggtgtgtttgaatatcatttttaaaaactgttattagttttcaaaaactagaaaatagaaaaagttgtttggttggtgaattaagttttttagttaagttataatgaaaatagctattgattttcaattgtggcatccagcttacctatgacttcccgtgtaccaaccttcctgccaatgccatttttctttttttctatatacttttatcttcttttttctccttgagaacatagtgtgcttgctattttaaccagctgatatcttaacccatttgttgttattgagaactgaaaaggaaaatttctttaacttgtttctgttttatagtttttaaaacactttttcataatagtttttaaaattcagtagatttttaaatgagaaactgattgataagtaaaggaaaaatgttttgaaacaaaaaaaaaaaatgaaaagtaaaacaaacaggcttttagttttttttttccccttcattttttctctttcaccaaacaacttaaaaaatgtcaactctttttttttctcttaccaagcaacttaaattgtttgagaattaaaaagtcattaacaaattaaagcataaagtatcaatcactatttaactctcaaaatatctcccaaataatcttgtttttggcgacccgaaatataaattttaataataaaaagttatttttgtaatccttagagtatctcaggcacttgttgctttgcttaattaattacttatttttataatattattgattagttgtttttaacattgcaagtgattcacgtgtcatattagacaatattgtttctataagcaaccgttgcttttgattaacaaaaagttgttattttaatggtggatcatttaagtgtgagtcattaaggagtggattatttaaggattacttaaaattatattactgaagcaaaatgtgtatgagttgattaaatataatgtgatattgtgaaagtcgattaacaaaaaataaataaataaataactcaaaatgaatatatggagatgctcttaatcaagtcaatgaagaattttggtagttgcaactgaaaagcaggacgtgattagaatagtaaacaatgtgccacaaacacatagaaaaccataaaatagcatattatgataaaaattcattggctgcacaacataaatgatcccatttgaagtaattttccacaaaaatattaaaaaaattatcatcaacattttgtttcggttgtaaaaaacattttattttaataactaatattaaaattagtacaaggaaaatttatggatataaagattatttgttcttataattaacatcatatttatttattacataaattttacattttttattaaaaataatttttaagtgtgtaggagagataataggagattcatttcctattttattttttactaaatgaaataaaacttaaacattaaccaaactaatataattttatgatgaattgaattgggttgggttataattgatttaaaaaaaaactgattatatgataaatttgtaaaaatgataaaattgaattgagtaattccctccctcaaatttaacttaaatcaattcccggatacgccaatagtggattcacttgattgagtttaccttaagtttgacatatgtcaaatataaaaactaaaatgtttttattattatttaaatgaatataaatgatattttaatgtttttgtttgtatctctttataatttacttttacttgaaaataagtttttaaaaacttatagcaattatataaaaaaaatttaaaaataaaaaatttaaaactggatattttaatgtttaaaaattaaatagtaatttcaaaaaaacattgttgtttgtatctctttataatattttgatacaatttaatgaattaatttagttaagttagtattttaaaatttaattacatcattgagtggaaaaaagtaaacaaatgaatcgagtcagagagtctaattaaatcagaaatggactagaaatttagtccaattcatattttttttacaaatgttaatcaattaactaatatattataatacttattgaaaaaaatgtttattaaatacatgttcaatatatataaaaaaattaatatttaattttaaataattaaaaatatatatatttcgattatctttctttatatcacttcacttaggtaaaaagtagaaacaacatatgcatgctgtcttcctacaacgtgtctcacgactcacgagaattgctaaaataacgtttttcttcaaccaaatattttataacactccttagaaagcaacttgtctgtttcacagcctgaactaactgcttgaccccaattactatgccaactctctcacattcttattttcaacagttattaacttattatctctctctaataaaatcattaagttttcaatagttattatctctctctaataaaatcattaaattcctcataaatgtaaccaaagacgttaaaaaaagagtcttactaacaattacttttaaacactaattaagacattaaaagaatattgaatataaaaatataagaaaataaaaaatcataaaaatataatattacacattttaatataattattttttaattccttaacatcagtgcccttaccactcttaccgtgcacttaacaaactaaaactagggtagtggtactaaattatcagatttagtgatgacattgaaacattataccaaaacaaacctggctgttcaatccatcattattgtttctgcaaaaattgaaatgtgccaaaacaagtggcactgtgatttgtgaccacaacaaatgcacgggtcattttatggttcagaccaatcaaccccagaaatattctctctctctctctctctctctctctcttttttccacacatattttattattattattatactattagacatacattccatgaaaacagataagtattgatgagtagatgtttcaagttgttgttcccagcataaatagcagaaaatgagaaaataagaaactctctcatgagttctgtctgattgcatagcattggttggtaagctgctcaattatcaagccaaccttgcttggttccactgcagaatttcagtttattcttatctcggtagattggattgaagtatttcttctctctctctctctccatctctttctctctcttcacttttcacgttttttgtttttaatttttttttcatcttcatgtctatcctcttctcatatgagtctcaaggtgttgtatatataacatgctgccatgtgcagcttgtgtggtacttgaaatttgaagacttgatctgcctttgctttgttatttcattgtcagcacccctctgggccatattggttacctcaactgcttttctgttcatccttccagaattattgtaaagtttccttttcttttttttattctgtcttttcatttttttttcaaagtgaatttctggaattttttgttttcaattgagggcacaaaaaataaacaactgactggaatttccatttgtcttgcggggtccctgagatttgaagtgtgttgttttccttttggtgggtggatcctaagttcctgaattccctcttttccccaaccaatttgtattgttgctgaataaattacttctgtctggcaaaggttgttgagtctctctagtgctggaaaattttgtggtgattcatgatgttttttttaactgaggaccttcaattttgtttttgtgcatcgatggttttctcacaatcacaaatctagtctccaaaattggtgatttcacaggggtgtgctgttaattttcctgtttgtttcatcttcaagctcaattctggttctgggtttatcttttactggaagacagactttgaggttatttctcatcccaacaattgttctcttctcccagcaacttaaatcaagtatcaatgggttttaaatttctccaagatctctctagtgtactgcattactagtcaaaactcaaaagtgggatctcagggtatatgctgaaaatatattgagaactgtttcccactttgcatccttttgacattgaaactactactttgttttaagagtttaatttgttgtgcatggtcattttaccctgtcaaccaatcagaaactcatcctccatgatagtttgtaattaaatgatagggtaaaaactctttatagtgactgtctatacactatttactcttgttttaaaccataagcaatagtagcttttcctagacatacatcacacaagatttggattaagtttcttttttgttgaatgacttaccctgtggataaaaaattgttaggaactaaattctgatatgcgtttcaggtagactccttataagtgcgcataagttcaagtgtagagaatgagtcagcctaagattaagcgccgagttggtaaatatgaggtggggaggaccattggtgaaggtacatttgcaaaggtgaaatttgcaaggaactctgagacgggagagcatgtggctcttaaaattcttgacaaggagaaggtgctaaagcacaagatggctgagcaggttgaatacttgagtaacctgggatcttactctgccccttaatcttattacttcaattttagaaagcataaatttttataacacaattgcttcttcacattttccaaaaccagacaaagcctattttttgctgaactaattttaggtgggaggttataggtttcagatgcttcttattatagtattttatattggtagttgctttgaagtcaagtctcttagattagatgtttctaatgtatttttgcagatcaggagagaagtagctacaatgaaactaatcaagcatccaaatgttgttcgattgtatgaggtctctctctctctctctctctctctgtggaccacacacgtgcaatgatttgtctctcttttttaaatcacttttttctttattttattcttgccatgtagtttttctatttttaatagctgcagatggtagtggttgagtctagaactttcttgtatgtttcactaagaattctgcctaatgcgtgtaccgttccagaaaatgcataaagtatcttggtaaatatttataatcattgggtgatttggaaggttgtttttttatttataaaattaacaattagcttgttcacttgattatggtatatttcgatgggaggaaagaatatagatataaaagaaaatacagataacattcttttatttagttgaagagatagtggaaagagaaaatggagaaaaaagttgacttctagaaataaaaattcaaacttttttttaaatcttttcttcaattcaaatttcaaatttttctcttctcattttctccccaccctaccaaacatagggagagttccaaatatgttgaatgcttgaatcattattattaaactgctgccttttatccaaggctaaacgagaccgaagaaagctttccaatcctctgttgctactggggttgagatattcttctatcatgaattgcccacgtgatgaatttttttatatatgtggaaaaaaagaagtcaggagttaaaataaatacgtgttaaatacgtatttcttttcagagttatttcattacttcaactcaccattatcagtccatcgggtaattaatttgctgatggtgctgttttgtgtgcttgtcatctagcatttgtattagtgcatactatccaactaaacagaaatttttgaaggaagtatatctgctaatagaaataaaattgattctcagcacagtttactttgttgcctaattctgtttctgattttgtaacatctttttttgcaggtcatgggaagcaagacaaaaatatatattgttttagagtttgtaactgggggagagctctttgacaaaattgtgagtaaatgaatcttcttggctattttcaattgattctagaatttttggaggaaaaaggaacacatagtgactcttttaacacatttgcagtcgaccaaacctctttagcttatgatactagattagtgttggcaaccagaatatgatccttgttcattcattcaatcatgattatcaatttatcatcatcattcattggcattgtagtggtcctggtggataggattcctttggatcttagtacatgctttccatctttattacatggaaaaagtgttgtatatgaattaatgaaaattttgttgtaaaggtaaaccatggaaggatgagtgaaaatgaagcacgtagatatttccagcagcttataaatgctgttgattattgccatagcaggggtgtctaccacagagacctgaaggtaaggcccctctgcctctctctctctcatacacacacacacatgcaggtgccacgacaattattttgagtttgatacaataagaaatgacttctaacatttctaattgttcacatactttctgcagccagaaaatttgctattagatgattatgggaaccttaaagtttctgattttggtttgagtgccctctcccagcaagttagggtaatcatgaattccattgccttctgacttttacttttctttggtatttctctttgttcagtaaattgatcttgctttttgaagtagaactatgacccaattattgatgttgtaaaagaacataaaacaattagaaagtatgaagacatacgagataagtggggaaaatgcttatcttattcagctgatggtaaaatatatgtttagttctaagaactgcataaagaagatcaatcacacaggaagataagaatagtaataggtgatttattttaaccagagacatgatttgatttgtcttaataatttagggatggatgagttaggaggttatgccaatagtaggtttaagatttaggaagagaaagcataccatgttttgagtgtgacattattgaagttggaacaagagttgacagtgtcagaaaattgtattcaatcattcattcatcattcataaatattaaaatccttttattactcagttatcctgtgccatcaattctttgatacctctccagaattacataaactatgtacaagtctgtgaaagggaaaactaaataattcacattggtaatagaaaaggccacaatttcattctcatggaatgtgtagacttgcaatttttgagtttaagaagataagaagaagtggttatcaagtaccattgttcccttttattgtaattgatgtgccaaaattagaatttgttttactttactcgatgaaaattaagctggatcctgtctaagacaatggtctctctctctcttcccaacatgtcaatggttataattttgaacatattcttataatattgatgacaacatgacgaagttgccatgcatccaaagatgtttatttttctcttgataggatgatggacttcttcatactacatgtggcactccaaattatgttgctcctgaggtacagacaaatgttatgctactttcatgtgaattgtataccgaaatacatacattttgagtcacactcctaactatatactcttgttatatacaggtccttaacgatagaggctatgatggggcaactgcagacttgtggtcatgtggggttattctctttgtattgattgcaggttacttgcctttcgatgaccctaatcttatgaacctgtataaaaaagtgagcactgtttactctcttcttcaaaaatttagtttttcctttgttttctgtttattatttttcatttcttgatccacagatctcagttgctgaatttacttgccccccatggctttctttcagtgccaggaaattgattacacgaatcttggatcccgatcccaccactgtaagaagcaacatttgattatatgcctgcttcttgtcatgtaaaattgatttttttttttctgaaagtaaaagggtcattttacttataacaagttataacctgcatttccttggtggcttccaatgatcactaaggacaaagtttttggcctgatatcatctgcatcagtttgatttcttgattatgcaaatcagtataatggttcttctagagctacatttatctagttctctgcaccacaacaaaagtgataaagaaaagataattgatcattgataatcaatctacagtatcatggtcatttttctgttctagttaatttttttggtcttgatttctgatttatcctgattgtatggcagcgtatcactatacctgagatattggatgatgaatggtttaagaaagattataagcctccagtttttgaggagaacggggaaaccaacctcgatgatgttgaagctgtctttaaagattctgaagtatgttgaagattattagatctgattttggtattgattttctgttagtttagaatcttctctcataaaggattttgcctgtgtattcaggagcaccatgtgacagagaagaaagaagagcagcctacagccatgaatgcattcgagttaatttccatgtccaaagggcttaaccttgaaaacttgtttgatacagagcaggttcaaagcttcacatgataagatgctttctaaagttttttattattgtgatgaacatttaaatttttacatataaactagtttctttgttagataaaaaatagttaattttgttgaaacttgaacttaatttggatgagaactttctttcaagccaaattggtgatgattatgagagaccttgctaaagttaccatgcttgctttattcttatgtcactgaccacagggatttaaaagggaaacaagattcacctcaaaatccactgcggatgagataatcaacaagattgaggaagctgcaaaacctcttggctttgatgtgcagaagaaaaattacaaggtaaacctatccccttgacaaattacaagcttctactcagaggggactttctattaaataattgtttgtaaaattaataaatcatcacctcctgcagatgaggcttgcaaatgtgaaagctggaaggaagggaaaccttaatgttgccacagaggtatatgattggtttaattaatcatctgtttcctgtacctttgtcaacttttcattttagtccctatacataaaaactcattattttggtccctatacgagtaatctcttttaaattttagtccttatgtctctatttttagtggttttacactgccaaaaaactaacacaaactaaaacataaaacaaaattgctcatataaggactaaaaagtagcgaaaagttggggtaagtatagggaccaaatgattaactaaacctgtatgatttttttgttttgttatttggtgatgtgggacactatttatcacattattgtactgaaattcaagtacccaatcataaacagatattccaagtggcaccttctcttcacatggttgaggtacggaaggcaaaaggagatacattagagttccataaggtatccttctgtacccttctttgcttaattgtgttactgcttgccacttcaaagataactcttctattttcaattttaaaaataattaaagaagcctattatatcagcagttgggtgggaataagagcatcaatgtttttcattttgtcaatatcaactttttttataattaataattatagcaataatttgtttctgcctagtttatacttcctatttgtgttggtacacaattacatatttgaataaaaaattatgtaccttattgttcggaagctcttcgttatgcgaaggtaaaggggagggataatgtacgcagtcttatccttgcatatacaaagaagctgttttcggattcgaactcatgaccaataagttgttaagacacaattttaccattgtatcatgacttgtctcataattacatatttgaataaaaaaaaaacttgaatcaagtttcttatatcctcatcaatcatcatcaagttcttaaattaaacaatgacacgtggattttttttcccaatgattgatatcctccattagaatatgtggctgaattaggaaaagttttgtcgtttatttgacttgagaacttgatgacaaagacataagaaactacctaagttttgtcgtttgaataactaaatttagatcctcttgttcttgaataattggagacagattgtaatttcaattgtttgcttccaccctctgcagttctacaagaaactttcaacaagcctggatgatgttgtctggaaaacagatgatgatatgcaaatgcgagaaacaaagtgatattgttattgtcattatcaagtgtaattttctttatgaatgaggttctactattttccaatttcttcattcgttatttcctcttaattaggttccttcgtgtagttttgtttggatatttaattacatattactcatatattgcgtaccatgctattattttttgaaagcatgctgagttcatgttagaattttactcatcaacaattgcagttatgttcatgaatcaaaaaattgtaagaaaagttgtatatatatctatcttccttttctcctagtaatatcttttcaatttgttgttactttctgatatgtagccatatggtaagctgattaatcggaaaatgaaaatagatgattgagagaaagaggttaaaagaaaatgttattattctacaaaatataattgcccatgtctgaattgatgctaaagaatagaaggaagtagatcgaaatataatagagcggaatgaattagactaaaagtgtcgttccgtttaaatattttttttttttatatacatttcattgtttagtaaaacgactaaaagagcaaattataattttttaaatttctgtaagactttggtgtccaaaaaaattttccatataacttttactttaaaaatattttataaactatttattttatatccttaattaaaaaatacttttcaaggaaatgatgtttcataagaaaatgttttttattttaattaatttttcttatgtatagtataaaatatgtgaaatcttttatttttcaattaaattaaataaaacaaaatatctagtcaagctgtcagactttataaatttgttaacatgacacccaatccattcacttttgtgtgcttatttggtcagtggttagtcatagttaattctatattttgtaaaaatgtttaaagtttatacctgactgattttattttgggtattagtaaggcttgataaaaaaaaaaacataggatcaggtcacttctgcatcctaaccatatacttgtaaagtgatgaagtgatagttagatttgtaatttgcttttgtcttcttggttaaatatatttattatgttttgcatgtatgttcttatatttttaacttgtagttaattatacagttttaacgttttaaatatatcacaattaacaaataaaatattttatttattattttgatcacatgataattgattattataattataaaaattattccagagaatgaataaattatttaaagtattatataaaataaaaattaatataagatttaagatttaattaaactaaatatatactcatggtaattttcttaattttttatataattctgtcaaattttgttgaaaaataattaaaactgaaaaataaaaaaggagaaaaaatcataagtagaatgataaaaaaaaattgtttatttagttaatctaaaaatgatagtatatcttttattaatttttgaattcaaatttatttaaaaaattaaattaattatcaatcaaacactattaacgtagttaaatatatctaattaaaacaatcaaatatttaatatatcaaccaaattttaataaattataaataacatgaaaattaatatttaatgatattttaaatcacacaacataccaataatgatacggtcagcccaaatagcttgggctaggatcagttttggacccacctagatttcgtaatttaaatcacacaacataccaataatttaaatttgaaaaaaaatttaattactacatttttaaagagttgaatgcatatatattaataatataaaatatatttttatttttattcaatcataatttactatttgaattacttatcataattgtgattggataaatatgtaaaaaaatttacacggtcagttcatgactttttttttttctttattttaaatattttaaaattttaatgtcattcttaaagttttatttcagtaagtcaggcaataaaaattaacattaaaaaccaacgccaaccactgtaaaattttgattttgagtgaatgataatactcaaacatacctaattgtctaagttgtcctggtcaagcgacaaaaatcgtgatgacactttaggagcattttctttgatttggattaattggattctcagtgagaatctcttttccctttttctcttttcttttaactttgcatttattttttaaagtatatacaattctgcaatatttctttctattttcaaaaatgggaagacgtttgaacggtattgcagtcaaattcttatatgaaccttttttggtgggcatcaccatcatgaagcactcacagacacagccatgaatgttaatggtgggccaaaaccaacaaaaaagttcatcatttgtgtgatttttaaagcattatattatcaaccaacaaacttttcaacaatatattttattatcaaaagacaatgtaaaattatttatactattttaggtgcataaattatttaatcataagataaattacataacatacataagcgattatttgacaaaataaggtacgtagttttcctaataaaataattataatacattacttggttggtatctttttttaacactttattataaattaatattttccactaattttttttaaaaaattatttaataaaaaagattaacatgaaattttgtataaataaatgctataaagagtgttattatttattaataacaatttgttcatgattctagaaaagaaaaacaaattgtctatgatacgtttacttgtttaaccaaattgttgtatataacaatttcttagaacgttaaaattgaaatgcctcactcttattgatttccatgctacttcatgctgcataggtttctgtctcttccattcgcactactataatgtctcttttatttgtttgatgatgatgccaacagtgtcactcaaacttgttttcaaggaaccaacattagtcatttttttccaccatcaagagacttttatttggcagtcaatttatctgaaatattttcttcatccttcaatctactttacttgcttgttaggtaaaaaatggtatcttttggtgctgaatatcatattggaagcgcttttacgtgatgcccggtatttcgtttttgttaggttttggtttagggtccaaccaagccaaacccaatattatgctaccctcaaattgctaactttccatttctgcaataatattcacattatggattggtgaagtctgtttttttttttttttttttattattatcctacgcttgaaatataactatatatcccctgcattgtccatttccaaccaatttgatttttctgatgttattagaatcaatggaatttatatatgtaatttgtgccttctgtgtttgtattttttgttctttttaattgttgtcatttaactgtgtattattagttgctgattagatttatatgattttgattctagttcaattggtttgttgatgtagcttaaaaccttgtttgtttttgtgtctgtgtggatgatagaacttcaggactaagaggttgttgagaagatggttgggaaccctgcactccatgtctcatcattgccaacttctttttcttcatctctgattaccctaccaagaaatccttcaagtttcatccctcttccaattcgacgccagacacaaatcaacatgacaagagctacatctgctgattcaggtcatggccaaaggtcatcatcatcttcttcagaagcaaagaaaccactttcagctttgtcaaacattccatgggccgtttggaggcaaacattgcggccattaagtgatttagggttcaatgataggaacatctgggaaggtggggttggactgtttctagtgtctggtactgtcctatttgttcttagcttggcctggttgaggggcttccaaatcagatccaaattccggaagtacacagtggtgtttgagtttgctgaagcttgtggcataagcaaaggaacgcctgtgagaatcagaggggccactgttggcaatgtcattggtgtgaatccttccttgaaaagtattgaagtagttgttgaggtgtctttcaattctttaattgagcactttagtatccctggattaaaatcttgcttgtgtttgacattgtctgtttaacgtcgcttgcgtataaatttctccataaacatttataagaggagaagaaaataagattatgtttctgctgtgaacgctgaataaacgctgaagtgcataagttgattttaactgatggaaaaaactcgactctgtttacctttaccttttattttcttgtcgagtaagtgcttatggagaagtttatctaagtaggaccttagttgttgaattgttttattaaagcaccagttttccatttgcaggttggtgacgataaaacagttataccgcgaaattcattgatcatggttaaccagtcaggtcttcttatggaaacaaaaattgacatcactcctcgtgagccaattccaacaccttctgttggccctcttcaccaagactgtactaaggaaggtttaattgtgtgtgatcgcgaaaagatcaatggtgacaaaggaacaagtttggatacattgattggaatttacatccgccttggtcgcgagatagagaaaattggtatcatcaatagctatataatggctcaacgagtattttcgattattgaagaagcgaaaccacttcttacacaggtgtagtgctcttgaatgaaccgttggatcaaacaattttcttgccaacagaaaaatagataagttcatgatgataaatgaaatattagtttcttctatctccaaaaacataaaataataatggtgaatatgcatgtatagtacccttatgacattgtttatcatctctatgcagtaggtatttgtttgtttcttttttattattcaatcattctgtcatgcattgatggctcagatcaaagccatggctgaagatgttcaaccttggttgactgacgtccgtgattatggcctgttgaaggaagttgagaatttaacccaaaaccttatccaagcttctgatgatttgaggttaattgcctaaacttctatggctcttgtctatcaccaatttggcttgcatgcatcattatattcagattgccatgtactcatgtagcacattgacattacccattagtgtaggggatgccaactaacatagtaacattttaaattctgattgagggagacttgatgggataatggcaaaaaaatgatgtcgtaacttgtttcttgtgttgcagttgcacaccctataaattgaaattgatcataaagtcctcttattttactctagtaaataagaaaagcattcacctattatgtttatccagaatgtctgcttttgcccattaggactagacagaattggactgattccaaaattccttgtactctttaattttacactcagaacattcttaagtataatgactaacagaaatcaccctttgtgtacgcagaagggtacattcatccatcatgacccctgagaacactgaactgtttcagaagtccataaacacaattagttttaccttgaagaacattgaggtatgagcctaatgtggcaaaataactaaatctaattattatgaatagtatttccccatctaattatttgatttttggctgtatcactgcagaatattagcaaggatattgtgggttttactggggacgagactacaaaaaggaatttgaaattacttttacagaatctcagcaggcatttgtgaagtccaatataaagataggaagtagaaaatgacaggtaatagtattgtaaacaatgtttacatcagctgcaaagcagtgcaggcgtgttattgactgatggaattaatttctttgtggatgacctttattcccctgataaagttatctatctactcatctgtgttggatggactggtttttaatggttgacactaggacttcagaaagaaaaaaaagttactggtcacaggctcataacattcaaagtgtaatactataggaggttatgaactactttttgtttgtttttctttcccgcactttggttctaatataaactggcaaatgaaaatgacaattgtgatttccaacactataattcatgtcctcgtttgttaccttaaagttagtttacatgcttatttggtgtgattgttactcatgctactactctttgtccaaacgtcttttaacccatgttatttacatatataatgtacaattgctccttgtttttagcattgacaaaattaattttgaataaaattaattttaaaataatataatttatatttaaatattttcattataaaattaagttaaaaataaaatttaatataaattttttgatataacacaaaattactcaaaattatttcaacttaaaatttccgaaatcaactctgaaatcttctttaatgtaaaatcaaatatatgaaaattaatctaaaatcaattttagactaagaattaattattcaacatgaaaccaaacacaacattagtacatgacatttctttgggcagtgtaatcaacatttacatttcctttttctttctttaatggacaatggagttgatgctcgatttaacttgcacatcatggttttcagtacaaatttaaatatgattttgcagtaactacactttatctaaaatcatgagccatttactcagcgcaaaccctccataacaataagattttacacttgacctgaaaacctgcccatcaacattcttacgctgatttctctgcatccctatgactttctggacttgggcttaaaaatatttgccttgtagtatctaagttcttcaatgctttctctaatgtcatccaaagctctatgtctgtttaattttgaaggtgctctcttctgatctgcacaaatgataagcctttatagtttaaaagcaggcatatctgaagttctttctcagattgattaattaataattagtcaacagctccccttggaaaacaggaaataacataatgattataattaaaaaaaaatcaagtaaaaacaaggaccaaaatcccagaagtacttatatatccattgtttctcgtctcttcgaattgtgtaaatggttaccgtgtattattacaattgggggcaaagaatatttgtaagtaaaatatcattaattatgatcaagacgtccaaaagcaaaaggggtagtggtgagattccaagcttcaaagttaaaacatcaaaagaactaacaaataatatatcaacaagcatctcctttagttaccttgccaagtttctaagcatctttacgctattacatagatatctaaagtcataggcccacagcagcatagaatgtatatttgttcataagttgaattgtttttgaggagacgggtagcatgtccataatcttgtgtaagttttaaaacatcacttttttggtaactttccaattttcaccttctcaactgtattttgcccttgggatgttgagccaaggtcagaaatacaaaagagggggtagtcatgttaaaacctctgatccatgtgttaaagttgccctactaatatggcttgcagaaaatgtagggaaacaaaactaggaagtcaatcagaattttgacacaaaaggacagctgacagaaagaattctttatattttggtttaaaaaagggccatattaaattattaattcataaatcataaccactggaaattgaaaactttctgatagaaatgagatgttttatcatattacttaccagttcaaccaaatggagctaacctatattgcatcaatagcaccaaaaaaactagaagaatcatgtttacataacagatccagtaaaaacaatgcagtgataggcactggaactgaccaccaatctcaagcacaaaacaattccttctttttatgggggtgaagatggttatgggacagagattaaggccttaagggatcaagaagtgattgatagttcataacaaatattaaacttcagtatgatttaatgcactaataccaaagaaaatttaattatatactaattgtataatttctcacctttgggataccagcgaatgcagagagctttaacactactaacatcaacaagtacatgagagaagagacttgccaattttggcatatatttctgcaaaaattgatctagttaagacagaaccagaacatttcaaacaggaacaataggaaatatagcggtaccaaataaaaatagcagtatatgttttaacaaggcttgatcaggatatgcagaatggaaggggaactggtctaaaaaaatagagattctatattcagatgacataaattttcatcagtgtctcaagtctcaacctgatcttttaccagatgtccaacttcataaatgttatgatgtgttgaccaacataattaccatcacttggcaagcatgaaatataaacaatacccaatattgttgtattgaaatatgatgttatttataaaaaaaaaaaaattgattatgcgatgcgaccaataattttcagcagaaattaacaaaagaatccgagacttgaggaatacatctgttctataaagacaaacaacattatgataattagaatttataaattaatgatgcttcagcagagccactttctacaagttactatggcagaaccaataccttcagaaattgaaaatcaacatatattgaatttcctgccaagagaggtgtgtacgaaccaacattaacatatctcttaacaaattcaataacctgcaattttgcaagacattacagattttcattataaaagagaataaatgaatagaacaaagaaagggaaagagactcggtcattgcattccagtaaagaccaaaagtagtacgtcaatagttctgaaattacagcgaagtatataagtgaatatattctgaaatctgaattatatatataaacttcacagacataatcctccaaaaaaaatatgacataaatatcaaacataaaagtataaaacagaggtacaaaaacaaaaattaacgttgagaaaataaaccagtgttaatactaaaaaaaaaaaaggaaaaaaatttgctgataaaataaaaatataatattaaactaaccagtgttgctcaacaaagttgaatgctttggaagaggaggagatgagagtttttgaaagtatgggacgattaggattgaggatgaattttgaaaatattgggtgataaggatttatataagacgtttggattctcctagtagtattctcattacttaaatagacgtttggatttttttgcttaaaataaggtaaacttttacttttactgttttatctcttttaaaatcatagagatttaaattttttacggttttacctcttaaaagttactgttacttaaacttctacctctcttaaatgttaaaataaaagagatttcaggaataaaatagtcattacatcttcctcgatgtattacgtattctcagattcctgtggcggcgcttttcagccgcaactcagtcgcgataacgaccgctactggcgctaccctcagtctcactgtctcgatgcggtctgcggcggccggtcgtcgcactgcaccgctactcctggaaagcgtgcaatagcgccgctattaataagtatgattggaagtatgggtttcataaggccttaggtccttcaactacaataactagtttggggtgtggttctaaaagactagacacgtcactacattgatatcacaacataagaaaccatttgtgctacattaaacaccagcctagaagaagggaaacagcagcgatctgctgataactgtatagccttataagttataactacttaaatatattatataagttacacaatgaccagatcactctttaagtaaaatttaaaatgcatttatttcaactgttcatgccagtaacatgaatctttagagaaaagagaacaggttttctggtagggaaatttttttttctcagctgccaaaaactttcctgacatataatgtgccacacaaatactttttatgaaatttgtgatggataatgagaaattcaatttccttccatatactaagattctgcaatccctaatagacaagtttaactatttcatatgcctataaaaaggataacatttttttcaagttcattgtatatagaaaatacagtacccatttaacatgatagttgatagaaagtaagctcctatgaaaagagagcttgccacatgccacatggtatatttactacaaacctgcttctcagcttctccttcacttattgtactttttagcaccttcattgttaaccctaaatttattgaaaaattgttagtcaatgccatttaaaatccaattcaaaaggaaataaaagtgaactaaataatgttaaggaaaaacaaccaatcagcaactcatgaataatatagtctcaaatttcttcatattctataatttattaaattagtttatctattttgaaggatatcttacactccccatggccatctctctaataaaatgtttttttctcttaacaaaaattaaagtatcaaaatacaacatttaccacttaccactagctgcatgatgactttgacaccattctcccatcctgtcaaggcactccttagtttgatggatgaccaaatcaggaccctaaaaatagcagatactttctttcatacacactcttacgtgatcgtacgtactagattacctatttacttttaagcggagtgctaggtacacactctcatatagattacaatttattgaaaactgcaaaactaggggagattcattaaataaggtgaaggacccatcaaattttttgatttcaaataaaattcaacctatgagaaagagtgtattcctagcatttctcttgtaatagatacacaagatttgagcaaatgtgatcaacatttcatcctttgccaagaaagagtaagagaaaagaaaaacgattttttttttttttttggcagagatagtgtcaaggaattttgttaacataaaatagatctaatagcattttccctcctttttcagtaaaaaggttgggggctaagatcataagttaaaatttgatcaaattcatacttaattcaaatttgtattaaaaacacattacatagcaaaataaaaatgaaaagtcaacaaggcacccaatgaatgttgatgtttacactaaacaaaagaaaacaaaggagagcaaaagtgcatatccaaaaacaataaaagcaaagggaagctaacgattatttaatgctctaaactctattaatacacatttggtttaacttattttgaagaaatcatctttcatttttcaccaactccttggaagagaatttggagagagaaaatgaattatttccgttgaaaagagttataccaaacatgtgcttagtatgatatgcagataggaaaaaactctaaataatttcccgcttacaagcatcaaaatgtcgagtaagacgggttctagtctatggaataagcaagttttttccatataaaaaacagagaggggaaaaaagtaagaaagaggaatgttattagctagagacgggagaatgtagaatctcatttaaaatatagtgaagcatggaaacgaccaagtcgaaaacaaaaaatgagcatggaaattataacattgaattaaatacctccactgttttggctaaatttccatctgtaattatacaagcaatctccaatattctgtccacttcaatatttaaacctgcacacacagagaaggttcaacattcatcatcatcaggcactaaacaattcaaatgttatccaagaactgacagtaacacagtttgcgactaaagaatatatagcctacttggtgagcaccacaaaatagtaaatacaacaataatagataatcaaatgtaagattctaattatgtcaacaaggagaaaattgcataacacagaagttgtgcaattagaggcaggattagaaatgcattctaccggataaaatttacaaaatggagaaatgataactagcagtgaaattttataagcaaaatcaggagggtgcatgcagatgatgaactccaaataacattcagatcataggctgacagtccttcaagcaaaaaaagacatgcctttagcaggtcaagaactaaagttgataagcccaacaatagcaaaggtttcaagaaagcatttaaaagcataaaatagagagagggactgctaatctataacacggttttttaagaaaataatcctcggaaggatagaatactaaacaataattcaccttggcgagcacatgtttccaaaacataaagtttatccaaattgctaggaagaaggctcagttgagttactataattctaccttagatgtagagccatgttaacacaagtattggtacaatatcaaaaaatgtaagagctttgttgctgaaagatttagagattcgagaacaagacaaaccaaacacagagaaaaacataatgaaaaatatttatctaaatagaaacaagcaaaacacactccaaacaacccattctacaagcttaccagtcatttccaagtcaatccacacaagaggcaacttgtattcacatgaaggagtcactggattttcttgattttgtttcttgctttttaccggtacaatgtcaatgtcggcattaaccctcttgtcactactacctgcgccatgaagtatcttttagctgctagttcacttcatagtaatcaacataatgttccccgtagcaaacatccatccaggatatttatgtaactagttagtacaaataaatatggagaacaacaagttgactacagaagatatcagtatgaggtgattcataagcttattttttgttaattcgggtacaagcttattttttgagtttctcaaacacaagaatcaaaacacaaaagaagaaaaattgaacacaaaaaaaaaaaaaaaaaatagaagtagtaattcagtggctgtactagagctatgaagattagattacagcagagaaaaataaccataatagtagaaagaaagaatgggagggatagaaaaatagataaaggttgtttttttattttttatgcttaaaatttgcaatgtgttttcatgttgttgcagcagaagcactcatattcaacaaggtgaagacactatcaattagaattgaatcatcgttattttcgtttatatttaaaaatttgatgttttgtcactctgtctctgtgatacactctagcattggagcagtgcactgaacgaccaacttgcaagatattaaacacacttcattcaataaaaaaataaaaataaaataaaaaattcatcagcaacaaaaatgaacaggtgtgaaaccctaacccaaagttcatcaactacgcatggaaaggtggaaactgaatgggagagagaagagggaaaagggtaccggcagtggtgagaacatggctgtcgtcggcgtcgagttctaacactgaaaatgaatttgcgagtttctccatttctctgctctgtttctttctttctctacaattttgtttcattttagattttagtttttatgcattatcagcataaaaatattacgcagttcaccaataaaatatttcaatagatattattttaaaaaaaaaaatattataaaatcaacaaattatcttacatgattaactaaccatataaaagtgtataaactagtatttactttttttttatttcctttaaaaaaacatcaaacaaagaatcaaaagcacatattattagagagttaagtaccattgtaattttgtgtagaccttactactagtgttgttggttctattgttagagaataatacattaatttggcgttatgacagctagattatgtttgaattaaggaattaagtacaccacaaaaagaaaagagaagtcctcgttggtgtttgtaagagcatataaataacatagtcctccttctatatttttccacatcacatcacatcgcaaagagagagatccatcgatcaattaatttccaatggccgatcaactcaccgacgaacagatctctgagttcaaggaagcctttagcctcttcgacaaggacggcgatggtctcttttctcagatcccttctctctctctctctctctccccctcttatcattagatctcattccaatctcgttttctttcttacccttttgattattttgttgaatttttaatcttttcctcattgggcgtcttctcctttcactttttgctccttgatgtttgtgggtgtatgtataatgtatgaatgaattggatttgcattctcgctgaaatatccaacctttttcccgttttgcccttcgctaatgttgcttgtgatgtgataatttttcctgttctaggattgtggggttggttggggtgaatgttttcaactgtgaatccagatttgatttgtgggtgtttgatttctcgatcagaaattcggaattgtttgtgtggatgtgacatttggtgctacatgtttggatttttaaataacttaatatagaatggaaaaatataaacttccacccccctttttaggtggatttaggtaggaagagatggtgataatgatatgatgggaaataaagagataggaagaaaatgggttggaaatatgaaaatgtatgtttatataattactcgtataggattgaccccctttatgtttattgactgcattttttttccatttttttgttacttttgaagatatatctgagaatgaaataagaattgcatggtatgtgaatctcttatcagaataagaaagtgggatttatgattgattattgttgagttgtgcgtggtttataatgaatggaaaggattttttacccccatagtactggatttgtgagtcttgtatcgttataatacatttatagatttatgaaattgtagacaaaagatcatattaacctggaatattatggataccactccccatgttcacattcccgtcattagtgttgatgtgtttgaagctcttgaacgaaacttgggaatatgatttgagcagaaaaccaaaattttagatctaagtgttcgtcttataacgtgtttggttgcatgttgttgatgtgtttttccaacctgaagctaactaaattgacataatattttgctttgtgatgagtttccaaacatgcacttgattgattcttaaattggatcatgcatttccttgtgaggctgaatttcttgtttgtgtttaattttttttcttttgtttccaaatgatacaggttgtattaccaccaaggaacttgggactgtgatgcggtcacttgggcagaaccctactgaggctgagctgcaggatatgataaatgaggttgatgctgatgggaatggtaccattgatttcccagaattcctcaatctcatggcacgcaagatgaaagacacagattcagaggaggagctgaaggaggctttccgcgtgtttgacaaggatcagaatggtttcatctctgcggcagagctccgccacgtaatgaccaatctcggtgagaagctgactgacgaggaagtcgacgagatgattcgtgaggctgacgttgacggtgatgggcagatcaactacgaggagtttgtcaaagtcatgatggccaagtgaggaccaatcaaccataacaataacatttgaaagcacatgaacagaaaagggacggggcagataagttttgatgaaaaatctattttcattaggacaatcttcatttggggtcattagtttttgttggtcgggtttgtgtttgcttttatttattggtattgctcattagtattttctacttgtttgctctgtcccgtgttttagtagcttggattagctgtgtctcaccatgcatttgtacttcacttttcatcttttttgggttactaccatgaaactggaacaattggttgcaattggtgcttttacatgtgggtgacttatactgttaaaaccgtctttatgctattatatgattgtttctgtgatcattttgcatttctcgacttcaatccaataatgatgaagttaataacaacatggcaacgatctagatcaagagtgttgtgtttaatttgtcaacacgcctttagcaaaataaaaagtgattttactaataattaaagaaatatgcacagccttgccaacttgtttatgatctcgttttcgataactaggataataatgtacttaaaatgcaaacatcaaactaatacacgtcccatgaacgtgcctttggaacctaaataaaaaggcataggatcaagaaaatcgaagctaaccccaaaaatgtttacttagcaattatgttaagataatgaaacattatattatttattgttacattaaatggttctacgtgggacattgatgccgcacaatccaacctgagcacgaaagattttcccttactgatggcacgagattaatttctttcagaaaatacaaatccaaatccaaatccactgcgaaagcacaagcaaagtcaaaatcactgcgccaattcttaacatgtgggtgcttttgaagatgcccaatgccagaaccaccatcgtggaggcatcaacttcttcctctttttccttgggtataaacacctatgatagatcttatggaagatgtgatgtgataaaaagagataaattaaaaaaaaaaaaaatgtatttggctgatgaatgaggcattacttttttcactttttccttgacaatatatttggttgtcaaaagacatccatttttctacattacttaaatcaatgatttaaatgtttggaggattcctccactcatgttttggatgatatttgttggggttaaatatattttcgtcctttgaaaatacattggatttgaatttaattccttaaaagaaaaaattacatttaatctccagaattttagaaatatcaaattttagtttttttaaaatcatgtttgcttcttctatagttaaatgtgaccacgtggtcatcccagtcggtggttttgaagtaatttgatatggcatgtaactgattagaaaaattaaaaacaaaattaagttaaccaattaaaaacataattacaaaaagtaaaaaagtaataaaaatagatgattggagaagataatgttcctttgacggatgtcgtcagggatctattctgagttgatgtaattggttaagatcaagatactcattgtatccactcaccacactatctcctacctcttaacatagttaaagaaaaggactaaaatctaaatttctaaaattttggaatcaaatgcaaaggaaaaaaaattcaaggagtaaaatcaaatttgttatatttttaaaggtccaaaaatagatttaaccctattttttcattttagcttttgttatagaaataaaagtgtttgaaaaataattagtgtttaggacatcagctaaaatttgataaaaagttttttcattgaaaaaataagttgttttcgttatctaaatatttgctaagaaaatacattgaaaaataattaagttgttttcatatatctaaaaatttgaatttgtgattatttctcaacaaccttttttctcttaaaaacataattcttaagttattcccaaatttcccaacaacttttgcccaataaccttgtacttttttttctaatttattatgtgaaagctgatttttatcaacaaacttatacaaataaaaaatcaattctaattataatcaattatacatgtaattgattattgaaataacttttgcatctgtatcaaacacaccctcatgagaggacctttgaataatttatcccacggaaatgactttgttaacatctgttttcgggattttgatcctcaacagtttttagagaaactggatgaatcttatgaatccattcattttattttattatgcaataaattaacatttaaaattaaattttattaactttaatgaattgatttgcaactgtataggtgtagtttattttgaaactgtagaagtctagaagatccagatccttgtttcatgtttcagatgtccaatttgtcgtgattctgttaacttggataagtgatagcatccttaaaaagaaaaggaatcttcagtacatggtattgtacatttgtactactgtattggcacagtcgtcatgttataaatagtaacatgctgtaccttatggtacggcctaacctgcttaccatactgtggcatcttcatttctgcaccctttatgtcactcacgatggttagtgtttggttcctttgatcttggtatgttggacatgaaaattttaagaattagtgttggtctaagatttcattggtttactttaatttaaaatttttatctcgtttcatcttttttcacttttacactcatttcatttctttaatttaatttaaatctttcatcttttttcacttttatactcattttattcctttaaattaaatatatccttagcattagcatggtaaacatggagcggggacaagcatgtttgttggctttgtttggtgtatgtaaaatatcatgccgactaaggtctctttaggcatgcatgcaatagctacatacttcaaatctcaaatagaacaaagcttcaatcatggatttttaaaaaagaaaagcaagtaggcagaataaagtgtgcaaactaaaggaaccaattagttaaaaggagataaatcaccaagaaaaagaaaaagaaatgataaaaatgcaagggaagagggagaaaataataaggtggatagaagaatctcaatgattttgtttcacgtaagggaggaaccatatcaatgtctcttggggtgcagtgcagattattcaaataatataaatttaacaacatgtatacattaaattaaaggacaataatattttgggtccatatttctcataattagaagaagaaaaatgaattcattcaacaaaaatgtatcgacctttttccagtctaggaggtgttgttgatcccttaacttttttttttttatatatataatcattttaattagaacttttctctctaataaaatccaaaatatcttcacaattgtgcgggatccctcagacaacacacaattctgctcttgatataaattattgtatatatataatgttactctagagatagctagatcgatagaagatatcgcatttattcatgtgtcctcctttcaatgaaaatgaaaattgatgtcttcctttgattattgaacttgtactcactacttctactatttgcatgtaatgattacgagtgtgtttgataggaagaaaaaaataggtgagaaatagaatagataaaaaagatgagataaatagaatgaatttagaggtatttgatttaagagaaataaaaaataagaaaaagagtaaaaaataattaattaaattaatttttttttatcaaactcttgcaatcaatttgctagaaagcaaaatggattttttgtttgtccactgcatgaaaatcgattgaagttcatgggtccaatgcataatcaattactattttagaatatccaaaaccagttatgtatgaaagtagattttagcaactctagggaaatgaaaatcaattttatttttgaaaattgactatttttactatatacgctaatgataatcgactaacaacaaaaaataatcaatcattttctgcaagaaatgagtactattgatcatttctgcataattttgtggggaaaaaaatgtaaatcccacaactttttatttttctccttcaatttcatagctaccaagaaaagatgacaattctctctatttcttcattttgtctcctctctttccttcttttctatggaaccaaaaaaagtgtacaagaataatgtattccgtaacaaactattttttttagaagagttcacactattattttattagttaaaatctattactacaaaattataagtgagtctcttttaaataaaaagtgaaatacaaaattttataatttttaataaactttaactaataacacaatatgatagaaagtcactactctttttagcatttatttaagtaaaaagtgagacacaattttataatttcaagtttattatttgctaacccaacacaaatgatgaaaaggaaaaacagggatcaaaagtaatcgtgcatggattaaaaaaataagtgtagaaactaatgtttgtccaatataagaaccgagcggctaatttttcttaatgaaaaatttacccccgacaatattaaaatcttgacattttactcatctatatttttatcccggtaccagtagagtgcaatgaaaaaaaaaaaaaaaaaaagatgtgcctgattattttttttaaaaaaatcaaaactcatatttaaagaataaatgtcagaaaagaagaaaacaagatttgaaaatgagacaagtttttggccttaaaaactaaaaaaaaaaaaaaaaaatagttttgaaaatatattttatcaaataatttcaaagaatagaaaacagttttcaaaaatataaaataagcaagccaaatttgtttctaaaattcaatttttcccttctctttctcactttttcttccaccgagagaaaatatattaatatccatgttatttttctctctatttactttctctatatttcctgtctttccatccaaaggtaccactattttaagctaataatttgatattttgatccaaaaaacataattatgaccagcaaccccttaccacctccagtagcttcaccataagacaccctattgatacttcaataattcaagaaggaaaagaaacaaaaggtttaatttatcaatttgaacagaagcctcaagcatatatagacacaagcccttcatataccacctgtcaaggagtattatttaaattttcatctttacagactgaggctaccaaaaagaaaaaagtaaaaaaaaaggtttatataattgacaagcctcacatatttcacctcttgagtggtttgtacaggacaactgtcacatatttggactggaacctgtgagtgagtcccagggcaacaacagactttaaggccaaatttttctctatgaagacatgatttagcacaacatgttgaggctttgaagaggaacctatgtcagagttctccatacctaggacagtaagatgcagctgcgaaggaacggccatcggctcttttgcaaagtcttcctcagctggaaatgcttggccatagctggattcgggggagggtggtgcttcaaactcggacacaccatcagggttttcaggcacataatcctgcagaaaaccataacatttaaatcattaaatgaaagacaaatcaactgaatttttctttttgtattgatagtcaagtaaagcaaaattgtgaaacaatttgctagtttttattactcaattttcattcaacagtcccactaatgcccagccctaaaagcacaaaaacctatgaaaattggctttccatgaaccaatagtagagtgcagaaaccagtgtttcccgtctatgttcatcctatatctccacatatggcatgcagagtgcagacatgacaaaacaacataggatgcattaccctttccttgtcccacccacctggctacctgtccagtaggggtgtgcaaaaaaccggatcagtaaaaaaatcaaaccgaactgattctgaatcaattaaatcggttttatatccaaatagccaaactggtttagaaaactgactcagaactggactggcttttaaaaacgttttgaaccaaactgtttttcaaccaattttaaactggttctaagaaccaaacgaatttcaaactgggtttttcaaataaaaggaattgattccggtgaaaaccagttcggttaaccggacaggttttgtataaacattccggttaaccaaactggttttgtaaaaccgtgcatttattttttgttcaaaccagtttggataaaaaccaattcagtttcagttcagttgcaatccagttcgatccgaaccggtttttttgcacacccctacctgtcctcatcctcctcaccacaaatacaacataaaacaaagacctagaagagggagaggggggaagatcttcggcatctgttgtatgtcaagttcatcttaaaacccaactgaagcattcacattgacacagaagaaaaagatttcaatgcagacacacaattaaatatacaggagaacaaatttcatgatgaaaatatgttcacaaaatgatgttgttttcataaagagaaagaaacaaataggtcgatgcatacattaacatcaagaagattgcagacatgccccatctcatcagctacattaggaagctctggaataaatctctcttcaccatcaacaatgaacctgtaatgatatatacctggtggaaggactataaggattgagtgatccttgccacctcgctgtaatgccttcctgcaagtaataaaatttactggtactaatctcattgtagatcatttgcagttatgataacttatgtcaaatacaatccagcactattgttaccaaaaaaggagtcgttaaatctcacctagatgtccagttatcccaagatccctccacagccacattgttaccaccatagttccatgtaatcatgacagggatcccttgctcaggaagttgattaacaataccgtgagactcattctgccacatttgattgagaaaaggagggccattacctctttgtaatggagctagaggaacctgaaaaacacaaggaaattctacatttattttgaagtaatgcaaaattgccactggtgagatttacatgtttcctaacccagaaaaaaaaattcctaactagaaagaaattgaaatttcagtgagccccacacacacacacacacataaagaaagaaagcttcatatgtattgcagatcataaaagatgtataagaatatatttaccatttccatgggagaaagctaagtcaacaagaacagagtgctccagttataaccaaaaaactacactttccagatagagaaattttaattcacaaaactatacatttctgtcaagtgtcaacctcttcaattcattagcaaaaatcactcaaggaaaagaaaatttacaatagaaagtataagtataatcatgcaacttaagttgatccatcaacaagtatatcatgatttttcacacaatgcattttcagatcaaactctattaaatattaatatcaaaaaaatatctagcaacatgttatttaatggcacataataatattctctcttccaaatttatattcaaagacaggcaaatttaaggttttgttacttttttttcacaaaaaggaaaaaaacaaagtggagggaggttgttttgattattaatgcacatgtatgtcactagcccttcgtttacaaccttgagaacagctctaacatatttattagcctagtcaccaatcctagatagaggggcggagcggcataccacaaaaccactattacaagattgactactatgtttattagtaacaataactatttactaaaacaggaatgtcctctaattttcctgatttataggaaaatataatcaaagtttcattggagttgttagcaagggcatgtagctatggtgcaaaggtgccaccaaatagctatggacagtaattcatacaaaataaacttaagcatgtcttgtcttttaagttttgctggacatggaaatatatcaactctacacaagagagagagagagaggtgcctatagaatataactttttcaccaggttctccacaaatcaaagacaaaaaaaggacattcagaacattaataggcataaaagagacattgggcaaatatttaccaaattcaagggatcgatataacattgggtaggagggaatagaggcacagaaaaatattgaatgtacattgtatgccaagcttgtagtcttgtgtagcacttttgaaagtacaccctcaaggcctcaacagctattagaccataaccacaaaatatcttgtctgtaaaattcctttaagttacatagtgatgcattaataacaatattcaaaattattgcatcactattagcaggcagtatcatctatccgtattgcaatatttcacgtgttgtttctcaaatggagaaatgtcgaggaatgtgagtaacagaggacaggcatcacaaaaattgacataaaacaaaattataccattaaacaaataaaactgattccatgatataagtgatataactggtcacgttccaaacagcacattcacaagctcaatccagaggacattattgcatgcaatttccaaatcagacaaaattaacaagttaatactggtagactagaactacgaatgagtatttccaaatggcgtaactatctggtcacaaccatccacaatatgtgagtttaaccggaaaaagaattatgtgggatggcttaaacttagatggagtcgtgtgtagtagttgtgtgagctgtgaagctgagactcacataagtataaatctaataaaatgttttcaaactgtcactgcacaaaaggaggggtaactctcctaaaacagacagatataagtacacatcaataacagtttcaaaaagaacaagcaggtgtagcagtaatctccgagatccaccccctctgccctccatgccctccccaaacgagttttcaaaattcaaaccatatgcattcgatcaaaaccagccacattcctgttggtcactgtcatgcttattgcgtgtttgaaagcatatttctgcttcagtaaagaagctgtgaattatagcttccacgttattctacaatttttgttggatatggctcatctttcgcagtcagatgacaacccttcttgttggcggggtcagcagaaagccaactggggtccggggggcagcgccccctggcccgtagaggctaggtactgttgtgggcctctgattattagtaatattttacttttattagtagtttgggctagggcccatgaatagctgctgttaggttttcttttaaccctatttatattccccttgtaaactgagtgacttgtaacgagtggcggtgaggtgattatagtacagacaagctggacgtagcctacattgggtgaaccagggtaaattactgtgttatatctctcttccctattctctttgctgtttttcgatttgtgtgtgattgtcgatttccaacaattttgacgtaaatttttacatccacaacatgtatccaaacacaatgttattcaatctgaaccacgttcatgatgatccatgcaagaaaggacgaatccatcaacaacataattaccagatccgttcaacaacacatttagtttcaactccgatggcgataaaaaataaactcagtaaataatccacggtttcaacaaaaaaagtaaccctacctacactgcctcctaatctctcgctctctgtctatcatgcaccagacaaatgttagcaccatactcaccaaccgaacacagaaagcaaaatcaacgaatagcctagttgaccgaacaaaaccaaaattccaccctagctagtaaaattaaattcagcagaaacgaataagcgtgaagacgaaataaaatgcagaaaaatcgaagaggaagcaagagccaaagaggatgttgtggagagaacctgaggaccgaagaggatcggcgatctggagcggcgagggctctgcggcgggctattggccattgaatcggaggagaaggcgcgaaccggagggcgcgagtctggcgcgtgagttccacgtacggcgggttcggcgacggagggatcggcggcgccgggaatggatccatcttctctgccgttagtgtttcccatgcgaaaagctatttgcggaagcaatcgacggaggagaaaggaaaaccgaaacggtgcgcggcggcgacgtcgtcgtgttgtgtgtgtgtgtgtgtgtgtgagagagagagagagagagagagagagaaagagagcaatgcaatgcacgctcgcgagggagaagagaaacgacggaaggagaaatgatatagggagtgagagtagggaagaagaaggagaagaaaaaaaaaactggtggcgttgttgtttgttcttatcaacttctcctgtctgactctgatctgacgctgtgttctgtttggagtttggacttaggagagcgagaaattaaaattataaatttcagaaaaaggaaaaatgagaggaaaatataagccttttaatttatttatcttttccactctcgcctcgtcgcgtgtttttccacgctctctctgcaacggaagtacggaaatctcgcttaccctgtttcttacctatttttacctgcttcgcattcaattttcatttgatttcttttattttgtaattaaattattttaataaaatttcataatggttacttactactatttatatgaacctatgtatcgaaaaaaaagaaaacatcatgtattcaatgggatgtgactcattgattcttacaaaatattttaaaaaaaaataaaaatttaagtattattaagtctcaaaactaaaaattatcaaaaaataaaaatctcaagttaaatcaaattaattttaaagataaaactctaatataatcattttaatttcctttatatttaattcaactcaatctataaaatacatagttttaatcatcattttaatttttcagaataagtatgaaaataaataataataataataatatacatcataaatatatttaaaatattaaatattaaatttaaaagtcattatattattattaataatataacacttggcgtatataccgataaaaataaatttacacgacctaataattttatttatacatctttactcaaatatttgtaaataaattataagtatctatattttaataaataaatataagttatataataattttcaaaaatttaataaatatatatgagtgatttattattttgcaaatatatgacagtttgtaatttgtaattaaatgatcatgtaaaaatatttttaattatccctctacaaccaatttacttaaaaaatataatagtacaaaaaaaagtaatgataattagtgagtcggaaagtcaaaatccatgccgtaaataattttaatcacctgtaacaaaattcgcaagtttgaataataagatacaacgaaaataataatatggattgttgaagtgggcttacagtttagaaatttatttatgagaatgtcatgcttattatatgttttaaaaaacattaaatatttcatgttaaaaaataataaaccatattttattttatttttcttataacgagacgtagaaaagtaacgaattataatattttttatgaaaacatgagaaatttatttttaattcaagtacaacttttatttctaatattatttttaactttaaaaactatttttaaatatactaaaatgtatttttgaacttattcaaaaatagcatttctaattatagtatttttgacaatatcattcctgaaaatgcagttattttatctaaaggagacgtttaattaaaggaaattttttccaatggaaataatgagtcctaaaaataattatttctagcaatgactaaaatctactttgttgaacataaaaaattattgagaatatttataaatttcttgaaaatcaaataataatataatattgaccgaaaactttcattatttatcactttaaatgattcaataatgtgatattattattgtagtaacaaaacaaagtcggtatttcacctctctcatgagaacaattttgtgagaaatcatttaaaaaacatttatggaaatattattctttgtgtaaatgttacttaaaaaaacaaatattaaaaacaagcatactaactttaagttttcaagaaaataaatatttctcttgtaccttaagatcaaaacaaatcttaccaaagaattttaatgtggctaagcagaattgtgtcatatttgagtgaggttttttttataaaaaaaaaaaaaaaaaaacttaaaactcgagccattcttgatataataagttcaatcttcacgcatggttgttaactagataacattatcaattattgttagaatcacaagtggggtttcttttaataaattttttatttgcagttttatcatcaatttttaaaatggttagtcgacaaaatgttagatttgtatgaaaaatagcttacgatgtgaattttaaatcgcagaacgtaagattatgtgttccaataaagatgtacattcaatatccctctcatgtgaaggaatattatttcctctggtctcagatagtgttttgattggagtgggaaaaaaagaggaggaaagggaagaagaaggaggtttttaaatttttgttgtttgattcaatattttgttgactttaaaatagaattattttaaaataatttaaacaataatttaatgacaattttatactatcactttatatatattaaactatttttctcttcatctagtacatacaaatagaagtgaaaaggtttaatgactgggtttgtaccatatttttctttcattttatactctctatttattctttaattccttatcttttttcatttctcaaactctaaactgagaaaatccaatgtggttagttaaaaatagtgtgtaaattattataaattattgatatctgtgttggatttccacaaataaataataataaaaaaatctccagactcagaagactccgaggtgaagaagagcgtgcagattcattcaatcaacaagtgagaggtgattccaaatcgatcaccatcacatatttggacaattttagttttgcaattaaatagactcttatgctaaaattgactccttaccaaattgctttattaaatacacatatgccctgagaaaaaagtttccacattcattttaatcacaagcaccagattcagcggtatgaagacagatttctaagacgctttaacctaatttgtctgtatttcaaaggatcgattggaacacgaaggtgtgcatgatcaagaacacgcgcaacagtaaaagagaatgagtcgattgctttgtattctcaatttattgattttgatatcgacctatcctttatattaaagaaaaacatttacccattttagacgcacttttacctgtccctttctctctctcttttttttctttcgtgtccgatgaaaaattagaaattactatattttaaaaattgaaaaataaatatagttatatttttttatcttaattttcaagttcattagaagaaaaacaaactttgactaaatattttacgcaaaaacactgttaaatccaataaagtaaataatgatttggacttaatattttacgcaaaaacattgaaatatgaatgatacaaccttccaggaagatgcaccagaacagagccatattctacaattattccacgatcatattcaattggtggaccagccagcaccattcccaacattagcaattgacttgattggcttctaaccagcatttggagcattaacaatagttcaataccagcctcgttgttgaatcattattggttatgtcaaaattagcttttctcatattgaccaacagaatttgaagtatttgggtatcaatttgatataaattataagtgttttgaagaatttttttattagaaatatattatttttttagtaaaaaaaatttaaaaatatttctaatcttatatctaaacaagttctgtataagaaattattatgtgattggaaatcatcctgtgtttggtccgcatcaaaaatgctcaggttaacttaaaaaatcatctaaattggggagaaatgacgcaatagctaaagtgcgtgcttgaattagatatatggcacgtttatacagaagcagctgaatgtagcttttgtgtcattttttgtgcttaaattagcgaatttgacaatatctgagttaaattataatatttccacgcaattttcattctcgaactttctcaataacatattcacgccaagctaactaatcctaaatatatttattggtaaaatatcccaaatatatttgttattttttgaggaagaaaatatgaacgataagttaacatttttatcagtattttttttacgtggatttcacttatagaatcaggtttaaattatttatggagattcatgtgaaattttatatagtgataaaaatagcaaaaggaatgtttctctaatttttttttttaaaaaaagtaaaataaaattggcgcaagagcaagggaagaagatgcacagcagtgggcgcgtggagtagcgtgctgaggagagaggtgtcgtacgtggcaacgaggacacacgtgtaagggggcctctcgtttggttttgtccaaagggctatgattgtcacgtgacgtacaagggattcggataagattctctctcttctctctcattgtgaaataaaaaataaaaataaaaaggaaaagcaatgctccccaattaccaaactccactttctaaattagaactcgtatggataatcttattaaagacaagcagagtttctctcttatggaaaaaagctatttcgcattcgattattattatgttcaggtatgatacttggtaacagagaacgttgaacaactttacatagaccaagaacatgtctggtgagaaataacagataactattttatacatttttaagcaatattatttagcttttcttcttctcatgggatatataacatgtagttggttaacaacatttatattataaatcacatatgtttcaagcacggaatgatttacaaaattaagtaaaatactcactttaacaattttaatatagaagtatttttttgttaaaatgtttaaatttatatgagactgtaagatccacaaaataaaatagataatttatctaattgtgtattatagatgttctaaggtatttatataaaataactaatatatataataaattgatgatgatataaaaattcttacattactatttaatcatacatgtatcctcaattttagactgaaaagtgaggtataaatttatgggtgaataaatgaacatattcaaatggaaaaggaacaagttttgtcgggcatcccaaaaggatctagcaaaccaaaatataatgatcgaggaacacatgtatttacttatcaatcaacttgtttaagaaatataatgatgtctttagttacttgaaatgttgtttttcgtaaagagcaagcgttgtatgcaaaattgaataaagcatatgacaaatccttacaatgtgaagggtcgtttattatgagaagggacaattctgatacttgtagcgagattagtatcattatgatgtaagaatattctttatttgtttctttggtgtttattggtggatgggattacgttattactcttcatataagcatttgatgatgtgagtaaccagtcacaattaacaagtctttagtttaagttaaatttaatttaattcattgtatttaaattggatcatacttttttttaaaaataaatcaggtcaaagcttgtaataaagtttatttaattaaacagattagattatatgtcttttaaaaagtcttttaagcaaaatagatcaacttattaaaaaattcataagtacacattcattgttaatattattattattatattaaatttgttataatatattaaaatcttatatatttttttgccttttttaaaatgttaatcatgttaatttatttaaagagtcaagtaaaacttataattaagtttattgaaagataaagtcatgtcttatttatatattcaaaaaattgtttcaaattatattttaaataagttatcatgaatgttattttaaaacttaaaaatatatttatatcatataaataagttaattttgattattataaaaacacaatatacatatttttatcttcatatcagtgttaaattatcacaatttcaacccttaaacaagttacatgcatacgagacttttttaagttatttaaaaaacacctttgataagtaaacatatataaatatgcattagtgcaacaaaacataatttataatagtttaaaatataatttttatactttcaaaataaaaaataaaggatattttgattttaaaaaataaacatcattcatataaaagctgcacatattaaatttaatataaataactaagtgactctttaaataaaaaaacccacaattataagaaaaaacaccaaaatgaatttatcctattttagataatagtatgacaaatgaatataaatataaattaacacaatataaatagaagatataatagttttaaaaatataatttttatactttcaaaataaacaagggaatgatattttgatataagagaaaatttaacatcattcacatgaagttatatacattaaacctaaatataaatatctaagagtcttttaatattaaaaaaacaatggttataaaaaaaatattaaccgttccaataaattttctcttatataattactcgtggatagaatgatatgaatatagattaatgcaagataaatagaatatatgatagtttaaaaatataatttatatctttaaattaaaaaaataaaatattttgatataaaaaaatttaacatcgttcatataaatgttgtataaattaaattaaatataaatatccaagagtctattaacataaaaaatattaatggtttcaatggatttcccctaataaaaaatataaatacaaaaataaaatggtgtaatggttattaatttataataattggaaatacaaataagaaaaattagtataacatataatccaataagcaaagctgttgtaaatgttaatcaaagatggtattttgtctaatctaaaaaaaatgtgaggaagtattaatgtaatttgctaaataaaaagaaaaagaaaaactcgcaaattgcaacatattacatgttggagaagtggagatccggcccggcccggtccatttacactgactgagaaataaccgaaatagaccactacttcacatcccaccgagagcacaatcgtatctcgctttcttctttcttccggcaaatcaaattaaaataaaaacacccccaattcccgaaaccctaaccctacctcctcgccgccatggctaagaaacgaaagcttcgatcctccgaccccgaacccaccaaacctgtcgagctacagcaacaggaccaagagccagttgaactcgaccaacaacaacaacccaaccccgaaccaaccctagaagatcccaacaggatggccgtcgacgaaccaaaacaggaagaagaagaagaaccgcaaaacgccgaaagcgaagaagaggaagaggaagaggaagaggaagcagaggaacaacaagaggagcggcaaccagaaaccctagaagagcaacaggatccagaaaccctagcggctgcaaaccacgcggaaacgaatggcggcaatgaaggaaacaacgaagaagaggaagaggaggatctcactctagaagaagagcccgtggagaagcttctggaaccgttcacaaaggagcagctccactctctcgtcacgcaggccgtggatatgttccccgaattcgtcgatagcgtgcgccggattgctgacgtggaccccgcgcacaggaaaatcttcgtccacggccttggctgggacgccaccgccgatactctaaccgccgtgttcgggaaatacggcgagatcgaggactgcaaggccgtcaccgacaaggtctccggcaaatcaaagggttacgcttttatcctattcaagcacagggatgatgctcgcaaggcgctgaaacaccctcaaaagaagatcggaaaccgcaccacttcgtgccagctggcctctgccggccccgttccggcaccaccgccgaatgttaccccggtgtctgagtacacccagaggaagatttttgtgagcaatgtgaatcctgagattgatcctcagaagctgcttgaattctttaagcagtttggggaggttgaggatggtcctcttggtttggataagaacactgggaaacctaagggttttgcgctttttgtgtataagtctgtggagagtgctaagaaggctttggaagagcctcataagaactatgaggggcatactttgtattgtcagaaggctgttgatggtcctaaggggagcaaggggtatcatcagcagcagcattctcattctcatcatcaccaccaccatcatcagcctcattatcagaggaaggagaagaacaagtattcctctggcggtggtggaccatcgcttggaagtggtcatttgatggcgccctcgggctctgctgtggggggtttcaaccctggtgtgccggcacaggggttgaatccagcacttggacaggcgttgactgcgttgattaaccagggagctggattggggcttgggaatctgcttggagggcttggcggtgccccggttaaccaggcgggaccgcctgctccgtatgcaaatcagcctgctatggggtatgggaaccagccagcaatgcaacccggataccagaatcctcaaatgggacagagcagtggtgtgagacctcatcctggtgctggtgctccttacatgggtcattaggtgagtggctcgtgaatttttgtttgttgttaatccataggctgccctatctttgaatgccccttgttggtaaataatgaattacacgaagatgtgtactaaaacgagtattaaaattagctaaccaattgcatgattcagtcaggcttctttcactcatggatgagcccaagtggcatacttattgtgtttggttgcattggacctgatgaaattatgctttccatattttgttttgcagttataatgttaatgtctattttggtaatctgtttctcacatgtgtgcctttcttgttttataaagatagtgatgctactatatgatgactgctcagtcttagctgttttagctacagttatgaataactatttgttgtgttttctctgagatctatttccatcaagtttcttgatctattcacagtctttgtgttaacattcctaggcttgtatttaacacttctaccacttgctgtcaatattgattttgtattgcataaacaattaccttgactgggattgtagttcaaatttgaacattattataactcttgaaaaatctattttgcagtaccgaggtatggccttgtaagagttcatatttgcatttgtgtttcttctataggcacttggttttgtgaaattagtttttttactctatgtattcactgtgcagataccctcataagatgcatcaatcatttagttttggactccgctgattcttctgaagtaccaggcactattcaaatgcatcttttaatctgtaattttagttactatttgattactaaagaaccagattctgaaacttgtatttttccccccttatcttagtagacttcccccctgacatgtttttaaaatcttgttatacctcggagtcctttatggactattgaggaacgggtgaattttggggaagagaaaactttatgataataattttttaagtgtgttgtggaccattatttttccttatgaacgtccaattctgttttatttagctttccaaagcataactgactcgagtataatttacatgttttacgtgtgtctggcattcagccttgatttttgagggctactaccatcttttttttaagtataatgttcttatccaaaaatgggaatatactttggggatttgaggactactgttgtagtcattttttatgattataggtaatgactactatttacttattaattccgtgtaacatttgaatatcaattatttcttctggatcccttttgcgaaccatttttccttccattgaattttttggctgggagattgaaagtgaaatgaagtatgacgaggaacaacattaaacaaggtttatcttttgtcataaatgtctttccatcatcctttcactcttgtcccctctatattcaaggatcttgttagagaaaatcattttttctttctccttcctgaatgaaaaagattgaacagttattgaaatgaattgttacctgactttggtcatctttttactccgttctgaaaataagcactctcagttctttgggtgtaagttagcttgttttcctagtttctacatgttttttttttaattagtggagatgttatgtttaactttgttggcaacttatctagacacataggtctttgctaccaaacaagcatgaatatgttcataacttctgtcatctgcatccactgatggagcttgggtctttccattcacttctaaggcaaagaaatgtccacacttggtgggagggttggctctcactatatacaagtgtaccctggtttggagtgaatgtcagagagaagatcagatgggtgcgatggtgttacatctttgcagttatccatgggtatgatcttttcttttgttattgtctgggaaagttaatcttcggaaacttgcttacttttcactttctgaagcttttaactaatttctgaagatattttaattctaatatattaacaagttgggtctggatttcgcttgggagttcaatttgtttttttttttttttttttacatacaatctttcttggagaaacttaacataccaaaataagttgctttgccaaaaatgtttttgaaaatcttgtcctagacagttatcttttttaagggcttatgaaggcaataccaaactgggcaaaagctgtagtctaagaaagtgtaatgttttcttcatgtttttatttgcgtgagactgaaaattgcataatttactcacaaggactaatttttttgatggctatttaacattctggatgttataatgaagatcatactgatattgatcacacagcttgagaaggcagttggcacatgcgtgaactgcaaatctggctctcaaacatcaagatattatatattggcttgaggatatggtgattaagaagattactgataatattccaaaagaatacttaactttgtcttgttacatttttgttggagcttcaataaatttgagctggttgatcttgggcgaggtgttacattgatttagaaattttaggtttcttccaacacttgacccccgaaacttttagtggaagaacctgtagttaaacaattacccccgtttttttgtttatgtgctttgtttgtgttataaaaacttgtcaacgaaattggaaaagggtaacgggggtttaaattcaattttctctatgctaagatttgcctttctcacgacggatttacggtgctgagtttacgtggaccatataattagacagaaactagtaaataacccgtgcgtacgcacgggtgcgttccgttccgctatgtttcgctatatttttataaattaattataatatttattataaataagaatatttttatttatgttattattaataaaatagtttaaattagttttcttataacaaagaatcacatcatgttccgcttcaaaagaaaatcatcaaaaactaaattatcatgtgatttatataaaaaattattgtattatttacaaaaaaaaaagctaaaatcttgggttaatctggataatccacctatgattggttagtaattgaacatataatatgacagttaattgtttgtggaagattttttgtcctggtaattgaatcattcttggatcaaactgatgttttctttgtaagaattttatctattcagcaccaaaatggtttgtccaatcttcctgtgtgttgtggttggaaagatattgcttgaccttgattacagcatctctacaaaatgccaaaatttcccttatgcagctgttaaggacctggaattaggagtaatgccaccttctttaccaatattagtagcatcatgtctataattgtttttaatcacagcatgtaagataaacatgaacatctcaatttatgactattgataataatgatttttccttttagtaagaaaatcatagaaataagatggttttgctggtgttttttctcctcaagttcaaatgtctctgtctttttataccctagaatttggaggagatgggtatataaatttgaaggagaaccaccattgcaaatgaaaatggtctaatagcagaagaacatatttatgaacaccaataatgatagtaatcaaaaggaaaaattgaaacaacttagcacattaatggcagtgatacatgataaaataagcacagcacaatagagcttgccttaaattaagttaattattccaaagcaaaagtccaactattgtcctcctctaaaaacacatttagaggtcacataaggagatttcagcttgctattgctaagtaaaataacagcaagtgaagtgatagatgataagagaagcacaacacaccagagtccaataaaattaatttaattattccatagcagaagaccaaaattgaaacaacttacaaattgaacttaaagatcataaagacagcttagtaaaagtgattgagaatatagtccatttcttaataccttgtctttctttcctactttgcccctctttgttgcaactgttgtcccaaagatgagcattatatctttcagtccaccggtgcctaatatagaaacaccctttagaaataaagagaaaaatcaagagtgagtacataggcaaagttctggctctaatacacaaacagcatttcttgatacatggttctgtctataatgcaaacctcagataatgatattgtgcaagattacaaagtactacatgtaagcaaaaatgaaatgacaatagagattgctaaaataaaaatgtaatgtggttcatgtcatccatagaaataacaaaacttaaattaaaagattgacagagcaaaaatgttaaacattttaccacttacatgatgaatatatatgaaaaagtcttgactttccaatgtcgaaggagattttttgatggctctgctactatcataagaaagtcaaacccatgtcacaaagggaacctaatctgcaaaaaaagtaccgataatatattattataatctatgtatggtaggaagtttcaagaattttttcacttttcattgctagcatgtttgaaaacatacaaagttcaatgttcattcatcttggtttgattcaaaattttcatttgcaacttctaagctagttatgcggcaaaaaaacaattttggcatcacacttgtttgattaatgatcattgaattgatcaataaggaaaattgttgggtaaaattttggcatcttggtaggttgctgcaagatctaaacattgaattctacaaattatgctaagatctaaacatttgttatagacaaatattaggttacatgacaaattactactaaaccaatcagcacctcaatacattagtctactcatgcaggaattcacaaaactaatctatcaataattgaaaagccaataatccatgacatggttccttttgtcgttctcaccaatttcaagtcaaacatacaacaaagatttacacctcaaaattcatccacttttggtgttatttaaaacaatcgtattgtcaccagaatccttaaattagtaattagtaataataaaatgtgtgaagctgactttaatagaatgaaaataacagaacagtgatataaccaaagataaggaatttgagataaatatagtcaagtgtaacctgcagagataaatttattagaaaataaaacaaaattgtcttagaagaaaaaacacaattcagaaaaaaatgtgcttcagtccttagaagaaaaagtataagtacatataaaaaaaatataaacaattaaacatattctaaaaattaaaaaaaaccatgtctgttttgattcgtattacgatcaacagcttttagaagttttaaaattccaattttatcaactaactgaggacagctgtcaacaaattaaatgaggggaaatatgaaaatttcagggcctaaagatattttaaatagataatagatatttagatgaagagaaataaatgaaggaacctagagaagataaggtaaatgaaagtagaagctttttgcttgggtcaacacacaaagctataatggttaagagttaagaaattgtttgtgttttgattgcatttgttattatcattttagactaatgaagtttcaaattttttctctcttcttgaagtttttgacacaacttttcacaaaagtacttgagttgattgatagttgatatgattagtttcatcatcttttaacttttttagcaaatgtaaataattagtttttgttttatatgtaaaataaattacaatgacaaagatgcaaacgtgtacattgatcagtaggagcctaatatcagcaacaataattctaattaatatttcacactcgatcccagaagacatattttgaattaaacttgttgtgataaacttcaacctcaactttatacctatgaatatgaatgataaaaaaatttgagaaaaagtgcaaacaatgcagtggtttttaaaactgggcaagtaatttgaatgtcatttataaaaatgattacaataagagtctaccttgttttaggtttctcaatgtatctaccacaaatacatgtatacgtttcacttctttgggtctgcactcttataacaattggtgcatccttcacaattccatctatttggcccgacaatgattttactaattgtagcaacagttagacattggatctcctaatagcatactttcataatactatactaataacacaataaaagatgcaaacgtgtaccttgatgagtaggagcctaatatcagcaacaataattccaattaatatttcacactctcgatcccatgagacaaattttgaattaaactttttgtgataaacttcaacctcaactttatacctatgaatatgaatgataaaaaaatttgagaaaaagtgcaaacaatgcagtggtttttaaaactgggcaagtaatttgaatgtcatttataaaaatgattacaataagattctaccttattgtaggtttctcaatgtatctaccacaaatacatgtatacgtttcacttctttgggtctgcactcttataacaattggtgcatccttcacagttccatctatttggcccgacaatgattttaccaattgtagcaacagttagacattggatctcctaatagcatactttcataatactatactaataacacaatattgtaaattaataagcgagaaaaaatagattaactaaattaaatgatggtgtaaaattataaattgatacaaaaacatttgtttagtctcattaatctgactaagggtcttggcacttgctttctacataaaattttcctgctttgaatattgaaagattgcataaaactgtgattattgattttagatagattttcactttgcttatctatttgcatttagctattaacatcagagttgaaaaatatcacataagaataacattatttagacttataatcttattactaagattgtgtatataaaaaatattcagtttaaacctgctcctaaattttttaatttcttcaatatcaacattgttgaatagtttgcaatagcaataagagtttgaggttccaagtggaaacacacctacaacaatgaacgtgaatctgttaccattgcttatttcttcattgctcaaacccagcaaaacagagtccgtttattgagagtttttagaggatgaagtttgataaaagagagtacaacagagtccgtttattgaggtcaaaatcaggggaaaaagaacactgaaaatgtggtactgtattctaaattaaagtatatttaagattggttttcactcaattgctatggcatcagccactcatatgaactaataatctaaagagttctttggtttatgtttttgctgcttggttgtttctgcttctatttcatatttcttgtgactcttattccatcattttagaatgattacaacaatagtcaaacaacaacatgagacctatgctaattcaaataaaaattttatgcggagccaatagctcacttaaccaagctcacggaggtcctccaaattatcagtctatcatcaatagacacatgtgggaaaaggaaagccagaaaagacctcaaaagatgaaataatgataacataatgcatgagtaagatggaaaggaaacctgcaatcccttagcaattgcttattcctcagcccttgtaggctcaattgtattagtatatacatggtcattttcagagtccaatgctaaatcaccatgagcattctacaacacaaataaatacatattataatatgagacaactcgacaacacctctccttgataaaagaaaacaaattcacttttaattttgaaataagaaaataaaaccatttcatccttaccatgatggacaccttgctcagtctcagtcatggactgaaatactatccatgtgcgataaaaataaaacaaagcaagcagtaattccaagagacagatcaaaaatgctttctcagtcctaaccccctaagtgcaacttttcaatagaacatagtccgtcattttttggcgtacatacaataatcatagatcattctaaacttgtatactaaaaaaagttaaaccatatgtagcaacatttggatatttagcataattgaggtaatgggtttctagagaaatagtttgtttatgttacaccaaaccaagaaatttcaaacccttactacctgaaatatatatagtaatgacaatacacacaaaaaatacttagatttctaattaagaaaaaccaaatagtctattcaaaaaatgtaacatgaccaaacaaaacacaaattatatatatatatatatatatatatgtgtttcttttatcatattgtagtatatcagtccaagtccatattttcatttgaaaaaaatcataaaaataagagaaatgaaataccataaaagaaagaggtgaactaaacaaagtgaaaagatactcagacacttccttttttcttccattttttctttccataaaagcctgcaaagtaaaaatacatagatattaagcacaacagaactaacaatcaagatgtcaacactccttttttttcttgctttatattttcctttcattctctatttttctatttaaacagaccctagtgcactgtcaaaaagtagtgtcctcttctctctattaataagataagactaacaaaataacaaagaaaaaggaatttcatgtttaaaaaacagaacatatattatgaacacccatatcaacataaatgaatataagggatttgaaaaattgtacctaaaaccaaacttgataatgtatgaggtaagactaaaataataaccaaagaaaagagatttcatgtttaaaatatagaacatatttatgaacaccaataacaacatactaaatatttttcaaatccaaacttgtacctaaaacaaaacttgacattgtatttttcccataccaaatgaacctaacaaattaatcatataattaaaaaaatacaatttcagaaatgcttatatttgaagaggaaacaaacctcatcgtagtgagctgtcaaaaaaaccactttaataaatatttgaagatggcttcttggtcgcagggtcgtcaccgtggcttgtcgccttcacaattgtgacctccatctccaacaccatatttgctgagaatgttaaatggattcttaacgtccattaaaaaaatgaaattttaacttttttttaacactttaagttttctcataaaattttacttaattattaaagttcttcataaaattagtaacttacctttgtgagatagagtatacaggcaaatcaactcccacagtacgtgaagtggaagagagacgggacagtagtgcagtgaggcataggacggcaacggtggtgcagtgaggaagaaagagaaagataagagaaaaaagaaaaagagaagagaagatggacgaagagaaagagaaaaacggaggagaaggatttggtgaacataaagagacagagatggagcgaaagtgtgcaaaggaagaagaaggacacacctctgaggaaggagagcgacagaccaatttgagagggagagaaagtcataggaagaagaagaaagacaaagaccaatttgagagagagacaaaaatttaaatttcaaaatttgaaatttttgaaaagctgaggcccattagtctactttttgaaatttaccattttatctaagaagtgagacaggtgttaacatatgctattaaggtaaagatgtattttacctggcctaaagatttcttaaatagatagtagatgaccacgctactgtcatttcctctgcctaaataagaaataaggtatatgatctctaaagtccaaactttgtaggagatgcatagagaagagtcaaagataggtaaatgctaaggattgttgattatgctatgtagacttcattgaactacatccttagtttcatattatcaatgctggctgatttcagttcagaacttcaaataccatgattccaaaccaaaactcagcatttaattcatactaatgtacaacaatcagaatggaggagtgtgataaactaccaatcgctaaaattgtgaacaaattactgcctatgtacacatacatatgaggacaatataaacacattattatatttgtaaggatatcacttatcactaaaatgaaaaacaatacttcaatatagaatatataaatattggccgtaataaaggtatagaaagcttagcaagataatattaacatgatgaatctgattaattaaggaatcatgcagtaactaccatgcattttgttattaaacatttttataaagaagaatttgttcagtgttttattgtatctttttaatcaactcaattacctgttggactatatctccatttattgagttttcagtaactccttaaatgagggaatacaaagtgctttaaaaacgaaatgctcatgttacattagtgcatataaagagtgggataagtaccttagtttcagagtcaacatcttgcatgatgaattatatcatgagaaaatcataaaggtgtgtcttttgagtaaatagtgtaattgaagaatataaatgaatttaatggatacactgtcattttttcacaatctaaaaaaatactaaatttgtatattagtggaccactttagttagaatttatatataaaatatattaaatatatcacacacttaaaacagtcactctaaataaggttataacaacatctatagatataacaacaatttttttattgaaaaaaaagtaatgaccaacccagccagagcatcctttagttttctatgtcctgtaaataggaagagaatgagagaagaaacaggaccttgttaatgtaatgaccagagccataaatcaaaggtgagaaaaattgagcaacctttaattacaatgaacagagccatgaaaatagagaatgtaagtatacaacatcaaacaaaaacaaatttataacaaaaaaacacatgacatatcttgggtgaaatcatgtgtccatataatttcattcatatcacaaaatcaaaatatcttaccttaatagcatatgactgcaacaatattaaagatgaaattgacaattgaaatgctttgtactactaacaaacatttaaattactactcacaaacatttaaatcactaccatattacctgcaagctgcaacacagtgcacataagaaatggaccttcattgtgtctaacaaccgtgccttagtcatattgcaacacaaaatgtcaaatctgaatcatagttatgcaaacaaccaaacatctacactccaatgtcaataacaaactaatattaaaattaaaaaaattaaagacccaaataaattacaaaataatttattaaaatatcctctctttttttcctagcaaagtacctcagcttatcaaaagcaagacaaagacaatcaattaacacaaatataaaacacaacaacttgaaaatttacatcaacctctaacaattcctcagccactaaacagagagaaaaggcctaaaaaaatatgaatttttcatcagaacttccaatttattaatgagcttttgtaaatacgataatttttataggaaaatttacctggaccacctcgtggtctcttcttcagccatgcatgtccttatggtagtgctctccctcgccaccaccctcaattcaatctaaagaaaataaaatacccaaataacaaaaacacaaacaaaacattagcttacaggacgttgaagccctgactttgtgttgttggtaaagggtggttgcatgtctaaattgtcatgcttgtgtcatgagttgcaagccgacggcttacggtgaggaagcgatggtaccgtgaggaagaaaaacggagataagagaaaaaagaaaaagagaggaagagatggagaaagagaaaaacggaagagatggatttggtggacagagcgtaagctagaagaagaaaaaaatgaaggtcacataggaagcggtggagcggaaggtagaagaaaagaaaaatgaagaaagaagatgggagaaaagaaaatgaaggtaacgtgtatctgccttaagttttgaaatttgaatgaacttttgtaaaactggaaatttccattttatcaactaatagggacagctgccaacaaaataaataagggtaaagatgtattttacctgacctaaagatttcttaaatagatattagatgtttgttttatggatgagagcatgtaatagtttcattttgagctggtccaacgtgatctgtatactttggtggttggtcatggtggacggtatagcatgagaaatgctttacattcgcataattcctactgggaattttggtaaatgagtgataatcaaattcgcttataaaaaaatgcactagtgttattaggaatggcaatgactagggtttggttaggcatggcaatggagcgggtattgcattctctgtccgtcgactcaaaaatcgtttcccgtccccttctcaaatcctcgtccggttttaaaattcattcccatcttcgtcctcgttggagttgggttttcttcgtcccatccctgttatttgattaaaaaaaatttaaaaaaaattattaaaaaatcgaacaaaaaaattaattatgtaaaaaaataataataaactcacatttaaaatatgagattataatttaaaaattaaaaaataaaatcaatcaatctaattaaaaaaattaaaaaataatatatgtatatatatatatatatgaatatttttattatgggacggaagtgagtgtgacgcgggtatcagtaatctcatacccgtcctcacttttggctatcgaggaaaattcgaacccgaattcgataaactaggttttttcttgataaaattgggacggattcggacgtgtattcatgagtttgggtctcattgtttgatagagatctatagtatttgttcttatatttgtctttaaaaaaaaaaatacttgtcttattccatattgacgtgggtagttattttaatttttatttcagtatccattggatatttatatatacttacatctagtatccttactttagttatgtataaagtttataaaacaataaaaatatattaatttaaaaattatgataagtaacttaaaacataatattaaaggtatttacacataatattatatatgattttatctataagaaataattatctaattatcaaagtcaataaagtgattaaattagttaatttgtcatgaattttaattatattttaatattattcatgacattaaattatttaagagacgattatttttcaaagataatctttaataaaatatatatatttttttgataatttaataaatgtactcatttttataaaagaaagaatacatatcactaatagaactcatagttaattatgagtaaaaagaaagtcttatatttttataattaagatgaagaaaatgttttattttatttcttacatatatgagtgaagataatattaaaaacaagtaaatataacatttattttttaaaacttaagtcataaataaacaatattaaaaatataatcatttcacactataaaagtcattaatatgtataaatttatattactaatttgaaacaaaatatcaactcataattaaaagtcaatcttaaaaaacttatcatcataaatttatacataaaaataaataatagtttaatatatttatataaaatatgaatcaaatttaatataatgatgttgaattaaaattatttattctctgttagatagattgttattgttagtcataaaattagtaaaatatattttttatagagaaatatatatatatatataatgtaaattatttatttaagtataatatattttaattacatcaatatataaaatacatgacatatatgtgttggatgagatgggtactataatactcgtatccacatctatttccgcaaaaagtacaagtaaatactcgtttttatccttaatcttaataaatgaataattatcttctctttttgtggatacttttacccataaagtttggctccattttttcatcctttattcaaattcatgtttgtatcctcaagctgattttccatcttttacaaagtgacaaaatggaaaatgaaaatttttggaagcaagggagggtagattttgtataaaaaaattatgcaatggacagtttgtaaaatgataattttgtcactagctggtaaaatatcaaagacaggtattaattattataaaaattcaataatcttaaaattatttattgcattttaataaaactaaaacaaggaaccaatcatattaatgaaggcaacaggtagtgagtattgtaattgtcatatttatatcggtctattaaatcacttgaaaatttgtacctcctacaagaatttgattggtttaccttttgttcttttctattataattttgaacaaaaacaagaaggaataaaaaacaccagcacttatcattatcattgaatatcgctgttagggatcatcagggctgtttccattttggtttgatttttatttaaaataaaatttgaataaaataaaattaatatttgataatttgatttattttgatttttataatttttattaaaatattatttcattaaaatttatatactttctttttatattttaaattaagatattaaaaaatttgttaatgacaatttacaaaacttattaataatatgttaaatcttttacgataaaaatatatcaaattttcatttattttaaaccaaacatattgtaaatccaacctaactaatcaactttttaaaaaagtatccaaataaataaaaaagaattaataatgtttaaatcaatttaaatttaaacatctctattcttatgaataacaaatgaactagattgatctatcccgccacatcataatcttgccaaaagatggctggggagggttttgttgaaaatcagcatagtgctacttaagggtgagttgaccgagagaagaaaataaaaaatgtttaagtttttaatataagttgacaaatttagttaacgaacctatcctatagttttatatcaataacttaacctaaagttgattttgaaaatattttattttactagtattagagaaattgagtttataaaataaactaacaaaaataataattttttattttatttattttttgaataagtgaattaccaaccatattgagaccataactttataattgccaatcatattcatatatttaataacattttacacattttttctgtaaattcatagcgtccgaacgagacaacctcctaccttgttctgtcatttttaagtgggttgggcatatggatctactccactttctcactatcaccattttcatccttctttgttattatcattattgtacccctttgttgttattattatataaatacatttttaaattaattttaaaaaagtctgtaattagaaaaaaatttaaaaaacacagtcgttattttttttagtgttgtacttcaactggtatgggaagtagatgatacttttatatttttttatacatttatttaaaattaaaagcattcgtacaaatacaatacaaaaataaatttccaacttattcaaagcgcgtttgttttggcattaagtctcgtccccctccccccatgtacccaaaataaagaacccacaatgaaaagctgtaaaataataaattagtttcggaacctcaaaactagaagaagaagaagaagaaaaatacacctaaatcacattcatttaacacacaggttttcaaccttcaccatagaactcaactgtttatgtatttaatctactcctatatcgtttactttcctaaacaacattatcttttctaaagaaaaattgtcaaatactattaaatactacattaattatatgatattaaagttggtgggggcactttttggctggttccaaatggcccaaagaaacaaccaattgggaatgttgagtgattcatagttctaatatttttagaattcatttctatatttggtgcttcagataatagtagaataaatatttcacggggtaaaactatctttcctatataatccctccgttcttaattctagattttttcaaaactaattcacgtttttcttaaagaaattaaattaatcatataaaacctgtacattatctgtataattattataaaattaactttttcttatttatttattaatttaattacttcttattaatgttgggagagaaaataaataaaaacgaatatgtagcataaataaatttttaaagaatgtcttatacaatgaggaatggagagggatacaggcaagagcttgagccccattcctttagtatttcttgcatacatgcatatatatatatatatatatatatatatttaaattaattaatgtaaactatataaaatcaattctccatgttgttattattataaaatttgttaatgtaaaattaattgtgttggttgttattattactataatggttaaaatgataattaaaataaaataatgtaaaactaattatttatttattatttttatgatagaggttaagattattatcatttaaatttaaaattattcctatgttatgagtaaaaatagtaaaataaatttaaaaaattattacttattaaaagttaaacatttaaataattacatagagagagaattttttttttagatcatcctttaataaatttctggatccgtatatggtcttataaataggagcattcacaaagtcaaaaacctgtccctcagtcgccttttcatcagttaccctcgcactttgttggcgtttgttaacattgctactgtctccaaacacactcataacattccatcacctcacttcccaaaaccctaatctttcacttttcttctgttgtcacactgacccaactcctttcattaaaacttcataagaggaaccctttttagcacacccacacgaaattatcgcctgttcagctcagggttcttgtgctcaatatcactgattcaaatggcaagtaaagtttcaatcttcttgtggtatctttaagtttttggtgaatctctgagcacccattaggttgagtgttgtgtttattggcaagtggggtttggaggtggaaatcttgggagttgggtggattggtgagagaaaaaaaagcagttatggtgactgctgagaatgagattggtgaggatcagaaggagattgctgctcctaagtctccatggaagacccctactgttgatgggaagggaggtgatgtgtctgtgatgatgggcaccgagtcttggccacgtctctctgatgcacagagaccacccaagaatcttgagactgctgctgctgctgctgcttctgtgacaagttctggtgagattgctcccagacctccttttatgcaggttagtatgttctttgtgtagtaccattgtgattgtgatatggaaaatgtaatgcatagatttatggaaatgtaatatgttcttgagtttgtatctatgtttttgtcgtcttgtattgtaacaaaatttatttgtttaggatggacatttgtgtcttgttacgattttcatgatttaagcctgaatattgcaagcatgacgattgtggttactgattaacattagatggcatgtaaataaggaatagatttcattgtgttcttacggttttacaaatatgttaggtgcttattgttttttcctcatctatgcttttgattttgtgatagaaataatagttgtatgcttaatgcaacaaagttcttcttttttggtattgaatatcttttcttgtttgtgcgtgcatcggtttgtttttcaaaaaaaggtgaatggtgctggaaacgttaacccaatgcataagctgccattatcacgccatcaaaagccaggtgctaagcgtaactcaaatggtgcacctccctttcctgtaccaattcactatcatcaaccagttcctccattttttcatcctatggtaccgcctccgcacattgctgttcctggttatgctttcccaccaggtccaggaccttttccgggtgcagaaaaccctttagtgaagcctgtttctcaggcgcccggacaagcttttgctccacctactcatgctgttgatggcaaaaatgttcagcctccagtgcaggaagatccaaatgcctatgttggcaatttttctaatggaagaccaaatatccaagaacaaggtgaccatctcaatcatgcttggcatcatcaaagaccttttccttccagagcaaacattcctatgcaacatggtttgggcccaaggccatttatacgacctccattttatggtccacctccagggtatatggttggtccaagcttcccaggtaaaattccaattcacagtcctctaatttatgcacatagttgtgcaattacatagtgacacacatacatctatgcttcctcttgtgcccagtcacttgtggatttctcaacttgaatgctgtgtgaggatttttctctgatatttttattttttaatttctccatcagttagttttgtaatccaatttttatcttttggataggacctgcacccgtttggtgtgtccccatgccacctcctggctccattagaggaccccatcctaggcactttgtcccatatcctgtcaaccccacacctcagccaccgcctccagaaactgtatcgttgaggactagtattgtaaaacagatagactattattttaggtaagtaatttcattgttgaccctggcttctatatcatatttgatcttaatctgtttttttttttttttttttttaaatctgacatctgctaatctatattgtgagaatgatgtttccaactttcgattgagtgacaatatactgttattatgtatattgttattgcaaagtgctgtactattagattcatagatgccaagcccatatcttttagattaggataattgcataaatttagcctttggatgggattgttgccagagatgatgaagtggaactgatttgtagtgtttgggcttcagattgttaaagcaacaggaacaagctaatgaacattagaaatttcttaggaagtccagtaataatttctgttgattccattttctgtgaaaataaacagaagtaattcttatgataaagataatctttacaacaactgctgacttcagagccttcttttggcagtgatgaaaatctgcagaatgaccattaccttatttccttgatggatgaccaaggatgggttcccatatccactgttgctgattttaaaagggtatgtgtccaaagcatttttttcctcccaaatgtattataattttgcagatgttttctgttggtgagttccatgttagtccctgtttctcacttgccttatatgatgtgaattatcttgtaggtcaagaagatgagcacagacataccttttatccttgatgcacttgagagctctaatactgtggaagttcaggcaatttttcttttcttggtttagttatttactatttactgcatgcttgcgggtgtagacagggctaaggttctcattaactctagaatctagtttgttgcataaaatactttcgcccctaagctgaatactgatggtttatattcttcttgtttatctctgatattaatcttgggcttgggggttggtagtttcaaatgtttatgtcatgaattgtacatgaatatttttttaaaatatttttagagtaatgggatgcaatttcatgtttgtgagaagtttaatgcaacacatttatatcctattgatgatttttcaaaaattaaattgtcaagacctttattaaaattcaaattcttgtgttttgtattccataatatcaacaatgattttggaattcagattattcagtctctattttttctttatcttgctctagcagggaggctgattctttggtttgaacttgtgacttttgatcacaagataacaacaaccttaccgttgtgccaaggctcaccttctaataggcatatttaactgtttcactatatttcaaaaggaactcagttttgaaatattgtctacattgagtcatagtagtcaatagcgtgctatagcaggatagtgaagtggagtggttttcaattgtgtctacaatagcagctttttgcatgctatcaccgtgctactatgatatatacttataaaaaaccatttttatccctggaacatcattttttttgggggtaaaatattccacaaaaagttacctctgttttgacctctattccttcacacattataggactattttttatcccgtgttctgtgatttcttctacctttagacttcccaattcacattctgctaatattttttctatctaatttattatgtttttttttttcatattaatttcaccatcatctttcatttgttgactttattactatgttcttattgctccaagattgatggtgattgtgtgtgtaaaatgtgacctattatttatcatgaatttctttaatgttgccatttgttttgttttttgagttatctgcagtataaatttagtttgtaattaatatttaaaatagtggttgtctcgcttcttgcaataccgctatagaaattttcagggttagatgacatgcacagctatctgaaattgataactatgcattaagtttccttattaagtatagaataattcttttaagttcagcacatttgtatcatctgtagtatagatgtgttgagcttatgagttatgagaattacatagtgcgagttcgttactgttattcaagagggcatctttatctttgttttggctttttaaagtttaaagcagattatgttacggctgaagtatagatgaattatggagttgaagatggttatgattgttagcttatagatactaatagttagaacttcctgctttcatacgtagtatatttattatatatagaataacacttttagttctataggagccagctttaagtgcatgaaagtttgaagctacttttccaactacttgatttttttttttttttttttgtgttctttcgttttcttcgttgccttcacttgtaacttgccatatttttatagggtgataaaataaggcaacgtgatagttggtcaaaatggattggagtttcctcaggaaattcaggatcaccaacagctcagattcaacagggccaacttgtagatggtgctgtcaattctcttgagaatagtgatgctgttggagataagacaaaggagacttccgaagaaaatcctaaagatgctgttcatgactcaattttcgcagaccataatcagccaaacaaagatatgttacaagtttcacatatgaaccaagaaaaaaataatgagagccatcgttataatgataaatcacatgaaggtgtcaaattctgtgatgttgaaacaactaataataatttatgtagccaacaagaaactgagcccaaagtatttgacaataatgaggctggaaacatggatgtcttgactgaaatggatgtccgagacctttccaatgattttggcaatacttttatgctcgatgaagagatagagcttgagcaaaagatgctaaggaagactgaactttcttctagtggaaggtacttcgtagttctgtcttatcttattgatatctagtggaatatcagcaattgtttcatttataaattggcacttggcttgattgtgttcctttatatattttccacaattttcttcgaagttaataatagacaactattaatttcttcataatgtgaaattcaaaggttcctcttttcctccttgttaaaactgtgttagtattctgtttgagatgttagaatacttgtctttattttaggcatcccatatggaatgatattaggtgatttttgtgccatttcattaagcatatcatatgttcacttttttgttcaaatattcatctgatggaagttgttgtctaaaaggaatgatgatgaagatgatgagatggctgtcattgaacaggatgttcagagactagtaattgtcacccaggtattgctgtttataatttaattaaaatcaagttcatatgtttattctttcctctaaagtggtatcattcaaattaggtttcaattttacattcatattgcccaaacagcaatggtgatgaaaattaaaataatttgagggtcttctgatttgatggatgttcagaggcgggaactacataactatattgctctgtatactacttaattataagttataactatacggctatgtaatgtcttttttttttttttttttttttttttgtgtttgaacgaaaactggtttaaccataatatgttagaatgttaattacaattaattgattatttaataattttatattttaatgcaaggttatcaaatttaggttcaaatcgtgaatcattatttgcatcaaatcggattcagagacaatgaaaaataacttaatgtaatagtttaaacttaaaatagataaaaacaacttaatcaaacatcttataaaacaaaattagtatgtgaagtcactatttttagaagaatgaaaacaaagcaatgaaatagccaaatagagtgcatgcattgaatgaatgacaaataaaataagtgcaataatcaaataggataagtttgtaagtgctcatcatattcctttccatttaacaatttaagcttatatgacttctcaatttctttcacgtgaataggtaaaagaaaggtaaagaaaaaaagaatgaaatgagattcatcttatgatacaatctatagatagatgtattgtattgaacgtaggattcaaatcatgaattgtaagattctaataactacgttctaatgtacagaatggtgatcctaaacaaagatctagaggtggtagtaaagaatcaatatccatttccaatgagcttgcttccgcaataaatgatggtctttacttctacgagcaggttgagtcactattcttattttccctgttgtcttttatttttcagatcatcatctttattaaatttttggttgccccacccattatctacaggaactgaaacataggcggtctaatcgtagaaagaataactctgatagcagagatcgaaacataaaatctccaagccataattcgggtgcatcaaatataaaggcagttgagaatattggtggaaacagtgttgaagagtctgggagctataattctcgaaggaaacaaaaagtttttcacaagcaaccatcttcccttaagcagcggtttttctcaagtaattttagaaatcatggaactggtcgaaactctcatggaatcatatctgaaagcccgcctagtaattcggttgggtttttctttgcttctacgcctcctgaaaatcacgggtcagttcaaaatgattgttcccagtgctaatgactgtaatattggtttgcttagccagcctttttttcacttttatcctttactggaagaatatatagtaaataatttgttaaattaagaatataaattattactgtttcagagagtatgatatgacatgttgattgtttggtatgacaactgaagctatttccattaattatcttaaatttgcagtttcaagccttccaaattgagtagttcaccacatgggggtctttctagtagtccccatggggggttttctagtagtccacatgggggttttgctggtagtccgcctgtgggttcaatgccaacgtcttttccaccgtttcagcatccaagtcaccaacttttagaagaaaacggtttcaaacaacagaagtaaatgataatgcatactggttgtatgcatgagagtggtactaggatatagtcctataggatttgctttttaaaaattcctcatgttagtattcttcctttcaggtacttgaagtatcataaacggtgcctgaatgatagaaagaaacttggaattggttgcagcgaggtgaactccatttcttacgtttctatgaaaaaatatttgtaaagaaccacattggtagcccaccaattgaactcattctcaatttctgttcctgttacttttattgtgtatcatgcaccgaatgtttaatatattgcctgccttttttattacttaatttgttaattgaatgacttatcttctaaaatactttgtgtacgagtatgttgcaatagtttgagtgaaaattgtggaatagttacaacacgtggcattttcaatattggtttgcattggtcaactttctctttttaacttaacaatgtcattagccgaagctttcatatcaaaatgagcctggatgcagtgctgtcatcttcattagctcactttgtatattatgcattcatatttttttatacatttcggttttcatattatttgcaaatttaatatttttattttcttgtattgtattctttttcaatcatacacttgcttattctggtaggtttttctttctcctccttttgtgtgtcaatgcaggaaatgaatacattatacagattctggtcctattttcttcgagacatgtttgtgccttctatgtataatgaatttaagaaattagctaaggaagatgctgcggctaattataattatggtatagagtgccttttcagattttacaggtaccaattccaattctgtcttttctcatttgtttgagaagatagaaccatcatttagatttcatcttctggtccattttgtcgagtaaagtaatttcaagtcttctgaattttcatctattgtttctttggagaagctgattaaattgctttatgttgtctatttttatttttatttttccttagaagacatccaagcatagttcttctaatttttgaatgatttcttgctcagttatggattggagaaggaatttagagacgatttatacgatgattttgaacaactcactctggatttctaccataagggcaatctgtatggcctggaaaaatattggtaaaaaaccaaattctcttgcttcttatattctactgcatattttctgttttgtagtttcattccttttcccaatttcatgtgagatttgttatagtgaaagaagtaaacatattggttggttagtgtataacctaagttgtattctagattaaaaagattgttcactggtctatgaaatctaattatacattaccttagttatatttttgattatttcctgtttgtctgacttgtttgtgtcacaaaatctttataacatagtttctaactgcattattggactgaaatggagcattttgtttattcttgatggtagatttgtggaacagtatgagcagttctaaatgttaagaatgtgcatgttataacactactcacctatgcttagctaatccaaaatagatcatcatattggaaatatgttagtttctatgtcaaatgctagcatactattttattagtattgcatttctatatttttgggtgaatggaggttgccatattctaaggcaaggcactgtctccctcatacctgttagatatagagaaatgtagttttcttctgttgttttggcactcctcttcaccatattatcactctctagaacttttgttcttacatatttatatttatatttatggcattggcagggcatttcatcattaccgcaatgtccatggccagaaagaaccgttgaatcaacaccctgaactggacaggttgcttcgagaagagtatcctagattggaggatttccgtgccaaagaaaagagtatggtaaaagaggatgtcaattaagttgagtgatatgtccaaatggtaaatacatatggcagagttttgatggcatccccaattttgatgagaactcttaacaacataacaatgagttgttgtggagtagcggccttctttttgaaagaagattgtttgtttcttctctatatttggttgagttgattacgcctcatcaagaggattgctgatagccaagtcttttcaggtttctttgatggatcattctatatggtatataccactgcatcctttctttggtggatcttgcaaactttgagagacacattttcttttctccaaatgttgtacataagatgatagactagaagttgtgacattacagcataagaaaaagaggttcttgtttttatttttggtgggggttaaaaggggggaaagggttgtacttatatctttgccaaatttgaacaataaaagtgagaatcttcttactttgtaacttggcgtgctcatttaatttatatgtaacaattattgtcttaccaaattgttattggtatggtttataaagcaaaatgtttttggtacaactaaaatgggacaagttgtctcctttaattttgggagagtatttttggaatgattgcctgtgaaaaagataaaaggcaaggtaaaaacaattatatgcggtgtcagatgaaatgaatttaaattatttgatgtttcttaatcatcatcaacatcacatttaacctaagttaattggagtcggtggtagatgaactcaatattagatatgaaaaagtttaaaaaaaaaaaaaacaaatgctaagaaaaagaagaaataagacaagagaaaagaaaaaattatttgatgtttcttgataaaaaaaatattagttaatgtttatagcaagtaaaattagtcactgaaatggagatattcatgacagaaccaaaaaattatttaatgttcaagtaatggaattgagtttaaaagctgaaaacgtagttttggtggttgacaagcctatttagcagcatcacagccaatgaaaacatgccagtcagtttccaaattttatgaaggtgaggacaaagataaataaatgactctaagaaatccatataagcactctctattggagatgctcttattaccccatatcaagtattcttgtttcttaatttattgtgtgctctttttaaaacaaaatcattattttgaaaaaataaaaatattattttctaaattctgattgcacaaaatacaagaacatcattgaaatgagaaaatcatatatttaaataattttttttaaaaatttttaaatttttatatttcagaattttcttaacattttaatttgaggtcaaatttgaattcttaattataacaatatattattagatacattttaagataatttgatgttattgaattctgtttcaataaattactttttatgttctaaaaatattgatacacaataatataggctattttgagtatttttttttcttttgtaattaatacttaagtttctttgatttggtaattatcttataaactactttgctatacaagtttattttagtgacttattttcataaattatttgaagtagtttataaaaaataaattagcttatagtttaatttttctctcttaattttatccttattattttatttgacattcggttttactctttcattcaatttaaaaaatcatctttttgttgtttaaaaaaaaatcctattatctaatttatcatttttagtaggcatgacaacgagacaggatgagttttgcattccccatccccgccctctactctaaaaccgctctccgatccctattgggattaaaaatatataccccatccccgatggggtcgattttccccgtctcgatccacccttgctgattaattaaaattaaaaaattagtaaaataatataacttttgttattgaaaaaatgggccgaaaatgctagttacataacaaaaaaataataaaaaattcacattcaaaatatgagaatgagctcataattaaaaattacaaaaccaaatcaattaatccaattaaaatcataaaatatagttattgcataaaataaggacatgcatatttaatttctcacaaaatatgatatcatttaaatatatattgtccaaaaattaagtagcacatcatatgattaagtatcacatccttcaaattacataataaaaaaagaaacaacttaaatataattttttaatgttatttttacggggaaaatccgaccccgaccccgaccccgaacccggtcgacttgatttttcctcgtcaaagttggggagagttcgattcgatccccacggggtcagattccgctgtcatgcctaataccaaatcatgtttttccctctctattttttagtaatattggtgactttttaatatttcatttatcttttaaataaattctaaaatatattttgtttaaaaattaaaaaatcaatcaaattacttaattaaatcaatctaatttttttggattgataaattttgaaatatctaaaaaatcttattgtattcaatcatttgaaatattttaattggtttaaatcttttttttttgtcaactttgagattttcaaataaaaataggtgaatattgacgaatgcagtgcgtttatttaaataacagtataagggaagggaaggaaggaaatcaactttggtcgactcgattttgaaagatttgtgactagtctgtaaattgaaatataggagttaattttagtttaattatattatataaattattttaaaatttagtttaagtcttatacttcttaaaaaattatttaaaatctcactttttagtgataatattaacaaataaaattatgaaattacttataaataagttaattaatataattatgtaaatttaaactttaataaattaataaacatatataatttgaaaagatgatgataaaatttatataataatatattatgtatattatttagagaaatattaataatatactccctaacactctatttataacacatatgtaatattagttaaaatttattaaaaactataaaattgagaaaaagtttttaaatgagaagtaggatcattaaaatttgtgacttctaataaattttaactaataataaatattgtgtttaaaataactttttaaaaatgtattactataatttctcatttatttggataagcaactttgaaagaaaaaaacaataaatttcaaattttaatgaataatgaatgtgacttgggcgccaaatttttaaagaatagcgcgtcatgctttgttaaataagaagccctgtgaacggaaagaaaggcaatttgagtttgaagcttcaaactttgaaagccataaaagattaaaagataaaagaagaaaacaatgtctgagttatataataacgattggaatgatgatgtttatgactacaatctgttttttgattgcgatgatatatggtcgacgctgaactttgctacccagattcctatggcggaggacacccaacaccaccgcacaccgctgcacgttgctaccctggttgcggaggacacccaacaccaccagacaccgctgaacgttgcaaccctagttgcggaggacacccaacaccaccagacatcgctgaacgttgcaaccctagttgcggaggacacccaacaccaccgcacaccgctgaacgttgctacccaggttgcggaggacacccaacaccaccagacaccgctgaacgttgcaaccctagttgcggaggacacccaacaccaccgcacaccgctgaacgttgctacccaggttgcggaggacacccaacaccaccgcacaccgctgaacgttgctaccctggttgcggaggacacccaacaccaccagacaccgctgaacgttgcaaccctagttgcggaggacacccaacaccaccagacaccgctgaacgttgcaaccctagttgcggaggacacccaacaccaccagacattgcccaatcacgtgaaccagattgcgtgggctccggtcgagttgcccagccacccagttgaggcgctggtgcataacggtggtggttccatgatgcagaacgctggttcatcggttcgacgcaagcaagggagaaggaatccatggactgaagaagaacataagtaagcttttaatatattgtatagaactcaaatgaatggaagtttctcaatttttcatcttatagttgtgttttaatggcaggttgtttttacttgggctccaaaaacatgggaagggaaactggatagaaatatcaaggttggttaaaacaagatcccctactcaaattgccagtcatgcccaaaagtatttcattcgccaaaatgcctcacccatacagaaaaaaagaaaaagcattcatgatataaaattacattacacaaatgaagttccttgcatcattgatccacaaaattcaattcctcttactggaattcaacaagttcaccaaatgcaacaaaaacaacaaatgttgccgctgaatccaccaaatagcatgactcatcaaatgagtggatttgattctgcatatcaacaagttcatgaaaatcaacaaatattgcacgtgaatccatcaaacagcaggactcttcaacttagtggatttgaaaattgtgatgaccacattggaatacaaggcttgctggaagctgtactatctgtactattttcaccatagtatgattctttaatcctagcataggttgtggtctggtgtaaggcgtaagagtagtgaacttatcaagtaattagggattttgatatttgtacatggattagatattggaattttctcatcaattactttcttttattgactttgatgtgcaggtcgtgaccaacttttagtaataatattacaatccatttcattcttaaaaggaaaagtaaacttctatttttgataataaattttaaagacttcttcctcatctgatccaagatgaatagcacacatgcacttgacatattagcatactcgctgagcaaatgtatagtagcttccattttttcaggcttacactagtgccttttcgatattcttagagatgagtccaggaacatccttgaggggatggaaagtgagtccaacttggcgaaggtggccatcaatagccccttcactgtatggaaggatggtgcaccatctccaaacaaggcttgacccccaaggccatcaagatgggtgtgactgcagtgatctcagaacaaacgacaagcacgagagcacccttgttgttttcggcaaggtctttggccagacgaagcatcgtgccaccggcaaagcagccttggtggtacatcatgtcgacaccgctggtggtgcaaaagatgagatgggtaatcttggacttgggttgaccaccatgtcttgccttgcatccaatgaagttgggaggagtggcggtgccaataggcaatagccatgctgacagtggcagggcattctgcacgttgtgcctgacggatctcttcaacactgttaattttctgaagcaaagaatgaaagtgaataagtagcaacgaaagaaaaggctttgatggatgttgcaaagtgggtttggaagggtggatatatatatatatatatatatagagagagagagagagagagagagagagagagagagagagagagagagagagacgtagaataatagaatgatgcataattgaattgaaaagggtaggtacatgcatgcagtgcatgcttccttcctctgatattgcgcttgtggtgtgcacccactgcatgtctaagttcaccaccgctgacaaccaacccacttgtttcctctttggaattacttttctatttctattgctgttttttaaagagttttcagaaaaataattattttcaatcacgtgttgtttttacgttttcctctttagtttattatgtttcataattattttactttttatatatattaaattttaaaagttttattttagtcttttatgtttttaaaatgtattattttagtcttttttcaatttttcgtttgaagcgtaagtatttcgttaatttttaaattaaaaatgatcaaaatgatacatttcaaaaacataaaaaatcaaaatgatacattttaattaatggatttcctaactaacctacccaagattatctaaccaaattgggtaatttaatataaaatattatttttaaattttatcaattaacaaatgatcactagtatacaattaattagaataggtcattaaccaaatctaaccaatttggttatgcagattgttgtgaggtcttacatgtttttaaataatatattttataaaattaaaaatattatttttatattatcattacattaaatagaataacattattgaaataagtaaataatatatttgaaggaaattaattttaaaatattttagttttgctttaaatttaacttatatttcaatttttctaagcttttttagtttgcggcaagttcttgaattcataattacaacaatatatttagtaaatatttttttaattatttactaaatttattaatgtagaagcgagaaaaaggagtcaaagtcattaaaaagggcacatataattgtagattaatttattaatgtagattattatactttatcttttgactatgacttagatgttgttatgcttgcaagactttggatatgataggaacgagtacaatgtactagaggtgaacaaggcttagttatgagaattgcatggacacaggatttgttcataacatatgaaggggtgaaggaagagacgtgtttcatctaactgaattcaagacctactacttcttaagtggaggaggctattgttggcatgggatgaaggttgctatatctgttactgaaggtgttgctgcacccactccagcaccttcaccagaaagttgttgtgcttcagatggcattcaagtcaaccaaatacctttggtgttaatctttgtcttgatgtgggatatctcttctgataacaccagttactagaaatggtaggccatatgtactatagcaccagttgtaattgttgtattgattttactttgtgtgatggtaagttaaactatggaattcaaggtatcttttaaatttactaataaattgtttggcctagtggtttagatagtttatatgaagttgtaagttcaaatttcactgtcccgctatcgtacacaaaaataaataaagaatttattcgcacatactactattataatagtaatgccaaacaatattatttgagaaaaagataaaagaaaaaaagggaagagagattgtttatcatgaactaattttaatgttttttttttcgtttttaacaaatcaacaattttggatcatgtgctattacttaaaacttaccaacaaagcaaattttccattagttttgtgtaagtagctactgcaaatgttggatttaaatgaaccctatatagggaagaacaacaggattaataagggaccatattctttggtttcatgcgaggcagttgccaatacaaaatatagagaatccgtatgggcacgaaacaaagtaaaatctaacttgttactacattaaacatttcctccaaaaccaatagtattagatggcacaaaagacaaaaaaattatcaataagatctctttgtgccgtttgatttgaagctcagtgcaatgaagtgaacttttgcgtgatatgatcaaaaagcacacaaaatatcaagcataactgttcagcaccaacatcagaataacaaagagaacaaaaacttttttgttgtctgctgtttgtccgtgttcagggtaggggatcagaatttagaaccataatgacttccattagaaagaaaacaacaaacatattacttttatgaccaacattgcctttgaaaaggtatttgcgattaacagtcaagaacagtgaatatcttttacggcttctcgtgttgaatctgttctacagtcaaggttggtaacaaagccacagcctcaccatcaatcacaagaaggtcatcattcttgaaacaccttgtcttaaactttgcactgaatagcattgagaaacattcatttagaaacaaaattactccttgtataaaaaagaatgcacaataataacagcaggaccaaacttacagatatcgatttttattttctctcagattagttgcttgcacttcaccaataatctgatctccaatatagactgggaacttaaaattcaagttttgagatacatacacagctccaggctgcaattattgaaaattgaagtggccagggaagaagaggaatttaagaaagttatcacagaatgagaatatttcaatgaatgacttcatagcattgcctcaattcacatcattaagcactttaaaatcaagtcttttattcaagttgaccaaatccaatgacaagtaccaatttttcaagcagtagaactagaacccatgttagcatttaaattgaccacttaatagcatgttggtgatttgcattttccaaccatatccaaaaccaaattcacgtcaagtatgccaagttaatgtggaagataaaaaaatttacttcgaaaggacgcggatcacactgacataacgccaatccagacacacgataagtcctttatccatgcttatattttcatgtctttcagaaagactataaaatttaagctttttacatgtgtctccctttctacttctcattaatcatgacacattttaatctattcaataaatgaagggtcacttgaccttatttcacactccttatagtgattacaatttcacatcttatccgtcttcattttatgatactctatttcatgtcataattttccattaaggtgtctaatactcaagtttacagaaaggatgttcatgggggcaaggggatttggatcccggaatcaacatagagttccccaaagctgctgactgtggcagaaatttcacttataaaaagcacaaacaaattaacttttacatgtaaaaatgtatgctacagagtacagagtataaaattcagtctagaaatctaataatagaactctactaatttatctgtttattcacattaatttaatattgagatgagaacgttaactatctcattttaggaggcatatcaaaatttaaagagagggtaagtatgaaacttacaaaatgtgatgagatgatatgaggaaagagagaagccacaagcatcccatgtaccagtggaccttcaaatccaacatctttggcagcagcagaatcagtatgcaaaggattagaatcacaactcaccttggagtattggagaacatcttcctcagtataaacccttgcttttctcaagacatccccaggcttaagtacattaggagttgcagaagtaaagcaccttaggctcagagaatggactttgtgacaatgtaaatttcttatgagcattcttgcaagggttcaaatcaacaaaacaaggccctgatgtggtcccccactaactgtaaatcaagtaaagtacaacttaatattcccacaactggtagatgtggtttcttgaggtaactggtggcatggacttaggtcaaacagctggtgggcgtttgagcagcacgggaaacagtgtacattggtcactggtatgggttcattgctcatggagggatattaacacaagcagaattatagggtgctgttgtcaagggattattggtctcatgcactatgtttgtcaaaatctgataagttttatggagcctagtttttttacggatcaggattcaacgaaacggaaagatgcaccacacaggtaaataagaaaaaaataaggaattacttttaaatttttacaaaataaattaaatttttttaaatatttttttttttcatttttagaggttgagtatatccaacttattttatgtcaatgtaactcttcacgtcatcaattttttctctgtgatattttcatgcattgttaattattgttcataaagtaattttaaaattgatctttaaaaaatattagagaaaatgcaaaaactctatctccatttttaagattcttaaatgctacccatatttatcattttcaagaattaatgtcactcatatctgtcaataggaaatcatgaaagaggtatatacaacattcatattgattttgactttttacgagaactaaatcatgcatttctttaataggctagtgaagaatacacgatggaatgaactggaaacctagctatagccgagaatgagctatagcattagcttgcctcttaacacatgtaaatttcatatgaacatgttgatattttttgcagaattttcacttacaaaaagcacgaacaaattaactttaacatgtaaaaatgttgatattctaaaaaactgtcatgttgatatttttggcagaaacatcattaagtacctttaaaagttaattaaaaaaagtaaatttctattaaaaaatgttcatattctaaaaatgaatttgaaatagtcaacttaatttttaattaaacttaatatttcagtttagattatcagcagaatgaagaataaagatgaaaaaaatatcatggaacaaaaaataaaactgttttatacaaaaaagaaatatatatactaaagaataacacaaaaatctaaactgaactgaataatagaatattggtcaaactgtacaaaacttccatatactttaactttctcattcggttcaaatagaaggcaatttttttttttctgtggataccgcatgaaagttccaatttctttgtaatttaaacgaccagaataaaagaaaataactaactgcggaaaaataaataaccaagttaaattcacgtaactagcattgatctcaaaatcctgatgaaaatatacctatttttaacacaactgagacattcttattaactcgggtcacattgctatcaggagtcgataatatggattttatccgtaaataacagacagatcacaaacaaactttaacaagaacagtaatacccatgtgatctttttgattcatgcaaaccacaactagattagataatgatcaagagtgcataataggaaccacataaaccttaacaatcttcaaaatagcgaaagacttcgcaacaatattcaaaatagtaaaagactaaacacatgtaaaggcatgagcaaaatgccttcttacatgtataataatcctttcctactaccattggcgcccatagttaaactgtttccacaaaaaaaaaataaaaaataaaaatcctatgaaggtcttataaacagcactgttatcagtcatcgcctatccctagaactgcaacagatccttcttcaacaaaagaacattgagctcgaaaccttatcctgcaatcttggcaactgagggacgggaggagcaggcataccagaaccaccatgacttgaagatgtctcagatttgtcctcaaatttcataaactgacccatctgagttgcagccagatgagcatagcatattggagcaactgcatacatccagttttttcaccaatgagaccctatatatttctataaattgggaacataaaagtgtaaacacaatgctaaaaatgttgtgcaagaacttaccgacagaaatggcagttgtgctcctctgatatctattgtcaaatagcaaaatgattttaagacaatatcgatatatggcaagggttgacataaacaatattataaaacaatcaaatagatcacaactactacttacacatatgataatgaatgcacaagctcctgtagatcatcaggtgaaaagccaatctcgtctaacagaacatggtagtgtgtaggcctgctagtaccctgaatagtaatttttcaaacaaatacaagcatgttattgaagttctgacacaaacatataatttatggaaaactcgtacaaaggggttcctaatctctaaataaacagtattcagtgaaatgaataacgaggatgatcataaaaaataaactaacatgttaaaaaatagaggcatgcaaatgaacatacataaacattaaattaagaaggaaaaatgaacatacataaacattaaattaagaaggaaagaagccagaatccttccacttcaatttgaaaacaatttcaccatgtgaaatgaatgtacatgcgtcttaaagaacatttgtgcactttacatcaacaaaaggataggagccacaataatggaactacaaattgtaaaaccaaaaccacattaaaaaaaatagcagatactcacaatcattccagcatgtgcacacatgtagaaatcataattccgaggatggcaaattttgttatcaattacagttcctgcaaaaataaaaaagagttaagaaataacaaaacaaaaattattgaaacgtgttaaaattcaaaataaacaagatgcataccaggaggaacattgtcaggagctccaggttgaaagaatttagtatgatggttcttttgagcaacaatcaccaaaaacttgggattccacttttcatctaaaaacttgcaagcctaatattaaagaagacaatattaaccccaaaaacacttcaaatatttaaaatttaaattcatcagctcaataaataagcacctcgataatttgatcaagttcaatgttcaaaacttgattgaactgggactcactaacaccatccctacatccagccaaaaaaaggtcagttcaaaatacacaaaaaggtcacttaactaacaaacatacaaattaaaaagattcattatgaaaaaatatgtaagaactaataaaataatagacataaaaaaggccgaagaaaaataaaaaattttaaaaaaatatatacaattcagtacacacatacacatatataacaacatacacattataggtccaacaactgatcatctaacataaaataggtcaggatttgcaaactaaacagaaccatttgttaaatctataagcttttgacatttgtattggtgacataaaaagagatttgcagaacagataacaaggatcgtatcatacaactttatcattcaaaacactaaaaaagaccatcaatcaagtcccttttaaactaatcaaatattacacaaactgccatacatattaaccaccacaatactagataacagactaacaacaatatatatatacacacacacaactcaaaaaaatttataaaaactaaaaataaagtacatatttcacagaataaaatgagaaaaaaaagtaacctgaatatgattatattatcgggctttctattcccagaacttgtatagaaatcaagtagaagctccctgcagatatacaacacaccaatgaccgtccaattccaaaaaatacaaaccacaaaataaacaggtaccacaaaaaactgtttatagtttataaaattgcaactaaactggcattcacttaaattcacttaaatttagaaaccaaattctgatcatttcacataaccaaattcaaaattaatgttaaaaaaaattgagaacaatatgatataataaatatactaggaggattaattcaatgatttgatacaaaattaacttaacctcattatgccttcatcctccttgtcggaaactttcttgaacaaattatcaatcatttccatcttcggagactgcgtacggacgctggccctatactttgatactagaggccattctctagagctgaccacctgcatgtttaagcattagcatataatcagatagtcataaaacattccaataaccaggaagtaggctcaaactaagacaatcataggtttgaaacagatgcccaatataaaaatcacataacaagcactaattaaaataccgcagcaattgaaggaatatctgtttgccctggtgaaccatgagacacatccatgccaataatgatggttggcgctctagaaacaataggaatagaaggagaatgctcaacgcctaacattgagttcagaccaccaagctacaaaacaataaaaaatttaatgacaggtacaacaatgaatcctgacaaactgaacaaaaagcattacactatatattccaaaaaaatagaaaattaaaccaggaaacaacataccttagcattgattttcaacagaacattagtcaaatattggtcattgacccttgtcggagctatacactgagtcacaattccaaaatcagcaagattcttcttcttccatggaccttaccaagttcagttaattttcatcaataaggggacttaaacaattgcatgaaaggagtaaacaaaagacaaaacttatcaaataacttaccataaagatcagaatttttcctctcaggaagcagacaaagaagaaactgaggagccccaggaagtttagactggaccaactcaaacatcttctcaactcgaaccaccggcggtgcacgcctaaactgaccattttcttcaaacacatcaaacggctgatctatcacctaccaattgcagttaagaaaaatatagtcagcaacttattatgcttcagagtcaatctgcagttataaaacttacaatgcctttcattccaccacacttaatgagatccctcacaagtcctcgtacatcacagcgtgcagagaagttaacaacagcccatctttctattttagttggcttgacaattttctggagaaaaaaattcaattattagaaaattcaaatatttttttatgaaattaatacaagagtagaatgacataccttgttattgaagttccacctcccatttctaggattgaagtcctccccattaccaaatttcaactacaaacgaaaatttaataatcagctttaacacaacattgataattaacgaataagatgccatcaacaacaaataaaactacatcttaataatttgacaaacatttccatacaaaaccaactagaattggttacggtagaacatgaagattatattaccaactattcttagacaattaagcaaagcaatatttaaagctacacctctctgagcacaatattaacaaaattaagtcaccaccacaatattcatcaatattcggtaacagtctatttaaatgaagatatagcagacaatacatgataaaaatgaataagcacatgcacaattataatgacttaaaatttacccgtggagcttgtaaaacccgaccctcaacttcagaaaagttggggcttatagagattccacaattgcgtagcattggttcagaaccataattgctacttttaagtgcctgtaacaattaaggtaatatcaggtaaaccagaaaatatacaacccaaatattcaaaactggacaaaaagacacatacatcagacaagaccctcatcctctcctgtggcttctgcctggacttctccaccaatgaagacctttgaagtgtggatagtgcttttgtataacgttgaagtgataccaaacaacacagctaagcataaaaagttaaaaagttattaagcagcaaagaagaatcaatagctttctaattcaaagtcctgaacaaacatataaagcaccaaatctacctcaagagggatgtaagttggcctttttggtttcccaacgttgatacatgggagatccccagaataccgaagatctatcttgcgaatattaacaaaataatcatataccgtcacttcttcctcagtaacatcatcaccttttttcttcaatgtaaacctacaacaccctaaccctgataattaaaaatctctaaaattaataataattaattatcaagaacaaaagcagaattaatgacatacgtttgatctttgcaagggagttcactaagcccagtgattttaaattcttgattagatgggctcgatttaatcctcaggttttttaatgtcctcttggcctgttcaagaaaataaataaaagatgagattattgtatttggcaatcaatcaagtactatgatcaaatggtcattgaattagcttacctttgcccaatcaagtgaaaaggggtctctcacattttgattggatattaggaagtcaaccacaggcccaggggtaattatcatggtggttgagacatctaaacatattgcaagacagaattaataaaaattatgaggaaacaaatgtagtgtccaaggcaaacaacagatcaaacctatgttcaaagacagtccactttgagtagttctaaaactagagtggaagcccctgcaaccaagtacacctcctcctacatcagcaaaattcctgggatcattgtgaaagaacgattgccgcacaagcaaacaccctctgtaaattgacattattttattattttaaattacaacataagagacacacaaaggcaagctgatacaataatgttatcaataataataataatagaagaaaaaagaaatgatcataatccacgcactgcttagcagcatgttgcctcaaaatgatatcaagcactcttattgcttcttgataattctcagattcctgtccacgtagagcattggcaatggcttgcaatggaatctttgaagcatagctaagctcaactttaaatgtcttggatctattagggcgcctcatcctctttttgtcactctcattcagttcttcattgccctctgggctgcagtttccattgtttctataacatacattggtacagaaaaaaaaaagttacaaagctgaaacagtaaaatgttaagtcaaattgaagaattagcatccacagaatttgaacctggtagcaacaacatcctccagaacaaccgtaaactcaagcttgttgcgagcaagagacccgagagtaaacagagtcttctcaccatcatacgcaaaatccttcccattcaattcagaatcatacgtttcatgcaccctgtcgagaagcttcctccctacacccttaccctccacaggtcgtccatcatcataaaaaagagcaacctgttcaaacataaacattgaataaatgattccaagttaaacagagacctgaaataaataatgcaggtgaaaatgaaagcacatacactatactgataaaaatgcccatcagtgtttgcaacgttcactctgtagtgattggtgagcagttgtagctttgtcccttttgaagcaaggccacgcctggctattggaaaccttgaagcctttttcttctccagctcagctttaacaggtaccacatctgatggtacaacgggaggtgggggaggcaacgaatcctcattctcagttccatttggcccgaaagaagccatctactgcatagttcatgcatgaaataaattgtgtcagcataagtagttagttcacatattccttcgaacaaaaaatttgaaaaataactaaatattttgagattgtccacatgcatatctaagcagacgccaacactatggtacaacaaaatttcatacaaaaaaaaaagagacaaaccgctatcatgcaaataaaaccgaaaaataaacatcaatttaagaggggggaaacaaaaacctagagtaatatttattactcaaacaggaagcgtaaaaggcaaacaaacaacaaaatgcgtttatacaaataaacctactgagaaaagaagtttaaaagcaacaaaatactcataaattatctacataaaaactctaatcatgcgaaaaacaatatagtaaaacattttcgctcaacaaaatgaaaaaggaacaactatcataaacagcaaaataatcatagatttacaaggggagaatatagaatctagaacaacatttctaactcaaattgatgaaacaaacaagtaaccagcaaaacgcattttatacaaataaaccaacatagaaataatcacatgcactgcaagcaaaataaaatacacaaaagtgcagtaaacgacatcagcacggaggacgtaaaaagctaaaacaagtaaaatttataaaaaaataaaatacaaataaaaacgaaattaaacaataaatacaactaaacacaaaaaagatactcggaggccaaaatcaggtaccctgaagcaaatatctggcttcggaacacaaatgcccaaaaataagtaggtgtggtcaccgattcggaccatcatcagagcaaacagagttttcgctttcaaaaaaagtaaaagcaaaaaaatatgttacggcgaaatcacaagcagtgaaaaagcacggagtaaactcaaaacactctgaaaaattaattttattaaacttagtgtagccgtcgattcgaaccatcattacaccaaaacagagtgttcgctaaaaaaaaaaaaaaaattaaaaaagcaaaaaaaaaaaaaaaaaacaacgacacagggaaatcacaaccaatgaaaccgctagaattaaactcaaaaaaacactgaagattctaacaaacaagcttctcctcggaagcaaaaacgagcttaaattcaacgaagcacagcgaaagcgtttcctctacaaaataaacatgcaaaaaaagacgatcaaagccgaaacacatgcagcaaaacaaaacattacaaaaaaaaaaacgtaggaaaatgaaagaacataaactacagtgaagcatttcgaaagcagaaaacgctaaaccatcaataggccaggattaaacggtgaaacaagcactgaggacgaaataagcggaagaaaaacgcagaaaatggcaaatgcagcatgtgatcatgacagatagcaacgaaaaaacgaagcaaaattaatgaggtaagaagagtaggcgttttcctcaccagaaaatcagtgacagaagcaagcagcaagcacaaacccaaaccctaagatggcgcagaagaagcagagagaagaaaaatgaatgcaaatgatttgaagcgtgattctatcactcgctcccttcactcttttaatagtggcagcagcgagagtgaatgtgagtgaatgtgcaccggttcgcataatcgcatcctctcattcctctgggggactacgaagagtaaaaataaatgacgcactctgctgtgacgctctatgcagtttgtgctgttccccgctctcggacgtttgatgatgaggtgtggtgtgatgacgtggagggctgagatccgatcacgtttctaggcaaaatttgatgacggtttgggattcggttcgtaaaggtagagcatggtcattacgtttgcactagtgggccccatttccctcagcatttgttactacttttttttttttttttttttttttaataaagagaaacatcgattctttcgataaaatgcctttttgtattcacgttcgtggcatttggtgtggataatgctgggggtgcaaaaataataataattggttatttatcctagaaatcatgttcatttcactagcagcaggtacaattttttactacaacgttatttttttaattttgaaaagatacataaaaattaacaatacataaatatgtttaaaattctaaacaaaatatgcatacgtgattaatttagctataattaaaagtacatactttgtttataattatttggttttaaaattaaataaataaatttaaatcagatatgtcatttttttaaaagttagattcatacgttaactagaataataataataggaaagagacatctattttatatcaaagtaaaatggttaaatttagatataataaatacagatgattaatatttaatgtcacgcatttatgttatgcgaattttaaaaaaaaattatgtaacattttaacattgaatcttaatcctaaatatacaattatactgtttagatttaatcatttaacattcccatataacatgttttttcttgtaagatgtatcatattattttaagaatatttttaaaaattattggtgaaacaacaccatattataaaaaaataaaaaataccatattataatgaatattggtaaaataaatttgaatattgattaaatgttttaggaaattaaaaaaaaatttctaatatgtaactaattaaggaaaatagtattgatttgatgtggaaatattatagatttgattcactcttatagtataaatttcgatcttgctttgaaattaaagtatttattttttggaagttattatatttctcactaagccagttgacattttatatattaagcatttaattcattttgaatttgaattctaatttgaattaaatttaaagttaagatatttaatcctaatgtactatattaaaatgcagatacatttgtttttgaatcttaattaaaactgaatttgctaatatcgtatacaatcttaacaaatcctaattaaattaaatttatttgttttaaatattaaaagaaaatatcatatcaacaaaggtataatattgttaatattcttaggatgacccgagtgaaattatacttggtcccttaaataaagttggtcaaacaatacttttaaataggtttaacttgtttaaaaaaaatgttgagtttgacatgttaggctttatcttcagatttactttagatcatttaaagacaatcattacttatacctctcaacttaactaaaatactttacttgaaattttcacacttttagaagtgaaaaatattcaacattccaaaaaatactttttgaagtgaaattgttgaaattttaacgagaaatatctttcaatttttagaaaaaaaaataaagaagcaattgcctttaagttgcttcgtatttgttatgtgttaatatattcagttgatcagttttaaaaaaatattatgagattttgtaagttgttgcttcacgatagtaatatttacgaaatcaaacgcatcccttgtggaagaatgacaaattattactcagcaacaccatacatttgtactgagatatcaatgggttggtctgatgggccttaaaagttgccgaaagccttttttattttatttttaaataggcctatataaatacacttcaaagactcaacatacttaatttgaagagttctacttcttacatcagcgctttttctaatacacccagcatgtacaatataataccaattttacccttctcataattcgaaaggcaatgggtgtatgaatccgtaaaggttcatacggattcgtaatccataagaaccttacgaattcgtaattcgtaagacgaaacgattttgtagaaatctcacagatttgtaatccgtaagagtaaatccataaaactcgtacggattcataatccgtatgacttaaaattttttaaaatgatttttgaaataatggtctagataagtgtcgaacccgtaaccttcgattacgagcattgtgctctaaccaactaagctactagaccatccatgttagaaactaattaaaattgctatatataacattacaaattttaatgtatatttaatacacataaatttacataattaatttttatctaataatatttttttacatatataaatttctattgtatatgaacctatgattttataaaattaaaatttgtaatatatatgaatctaatatttttttattcaaatctataatttttaattaagccatgatttttattttaatttattattctcaaaattcatatattttataattaaatcatgattttatctaataatatattttttatccaataaaatatattttttaaaaattaattgttataaaaaatatattttataattaaaccatgattttatctaataatatattttttatctaataaaatattttttctaaaattaatttataaaaaatatattttataattaaaccatgattttataaaactgaattcatagaagtcatgtgtatatttatcattttcaagtaataactaataaatatatttatgattttctttaaaagtaaaaaagaaaattataactttaaagttaaaaaaattacaataaaatcttaaaatcttttacgatttcaatttaaaaataaaaaaaaaaagttgtgatagaagttattacttataactcaaaaatagtaacacatgttacaacttatatacttttggtaaaaaatttaaaatccaccccaaacaaataattaaaaaaaatcacctatttgtggtcaaatccccgatttgaaaccaacttctcagagatgaaaaaatcgtcacagattaaattagaagtatcaactaacttagtctttatttactataattacttaatagagacattttttttgataatttaatagatacactttataatctatattaataatacaaaaaatctgtcatttgatttacatacattattagacaattttagtatgaaataactttcatattcttcatctaaacaagaacaactgctgctacttttatgttgtttcactttttttattaactttatttaacttctgatatatttttttaattatttaaaatgtttagagagacacgtatcaaatatgaaaaaatcatatttccaaggttacaatatacaaaataattttgtaaagaagttagcctttaattttattttataaaatctaatattaactagttttatatggttatttagattattttttctttatactccatcagataccgtttttaacaattttcaattacttgaagtgatttgtatgtttctgacataatgaatagttgttacacagtattctatttttatagacttaagcaatatttcatctgagatagaaagatgaggatatccttcatattaataaaaagaggattataagataaatggatccgttgacaaaagtgaggatgtaacaccacagccataaaataattaaaccaatttggattctcccaaccactttaggtggtgtcagtaatggtggttgcacaaacttagcattatcacacaaaatacgccacttaccaaaatgtactcgactttgcacatacttaccactatcacacacaatatgccacttaccaaataaactccacttttcttccgatttatttttcacatctgttttgtttttaatctccctattaaggaattcatcacttattgtttcaaacaataagtgtttagttttttcaaccataggtttaaaattatatctgatcatggaattgagttgaaataatagtcgaaaataataattaatttttgttagagatagtaaacacaaataaaataataatttattttatatttaaggattaataaaaaatggaccctaaacttttacttttttttttccagaatattgttgttgttggtaattttaaacacttcccttttaactgttttatgattcaattttttttttaactttatgattcgactatttaaaaacaaaggaagataaaataaagtaattttgtttattaataaaaataataattactattttagtatatctgtgatctttaatgtatttatatataaaatataaaattaattgtataaatgtattagagaatcacatttccatttttctttctctaaagatgtgtctaggactatttgacagtattttgagtggaattatttttaataaatacatgcaaaatattaatttatgaaaatgtagtagttctttatattaaaattactaattcactatttctcaaaattattttattctcttaaaaaaaatcaatcaaaaataattttggattaattgaagatataaaaactcatttgaaaaactaaatattttatttatttcaaaataacattcgtcctaaattattttatatagattaaaatattatataaataaaagaatattaatttaataaaattaattttatattacaattaatttatttacaatttttattatttattattaatattataagagatgtaaataataaaaaaatataattaattaatgttaaggaatatatatttttttttttttatatataacaattataatggaaggaagattataaaaatgaagcaagggcgagcatgccatgttttactgctatgtgttattcccaaagccgatacttccttttcaagtcttttctctctctctctctctctctctccatataagattcttccctctcccttgtctctctctctctctctctctagaacttcctcctccctctgcttctttctttcttcgttgctgcgcgattgctgcatcctcctccaataagagctcactgctagtgaaccctaacacggcggcaacgagaggtgttcggttgaagctcagatcagcgatggcagtagcaacccgcacttctctgcggttcctcctctccgtctccgtaaccctaactctcgctcacctcgccacctcaaattccgaaggcgacgctctctacacgctgaaacggagcctctcggaccctgacaacgtcctccagagctgggatcccactctcgttagcccctgtacttggttccacgtcacctgcaaccaggacaaccgagtcactcgagtgtatgtatcctctctctctctctctctctgtgtgtgttttgttgcttgcttaattgttactatatgttactttaatttatttatactactgctatcagttttattattatgcggtgcttgctgattttagatttttaacgaggtttgttattctgttaattggttatgaaattgaagggtcctccgcgaggttgcgggaatcgtcaaattatacatgccattaaaagttgtctttagatactttcttatgttctccatcactgggattcttttttatgtattttaaaattagatgtttgattttctggacgggggattattgttgcttatgatacgatacattgatacgatatgtgtatagatacatagagtaaatagtcatatatggaaattttgttgacttttaaaataattaccataaaagttatgccaacaatgatttttgatcgattgacaatacatagaaattgaaattcaactcatgcaattatttttaaaaatatgtaggatgtaatatgtgtgagatgcatatctagatatgcataaacaatttaaaatatgcaagtgaaattcacgtttctgtattacactgtatacaggcttctatcagttctatgtctcatatatagctatattagattttcatttctttttttaaaggcctggatacttcatagttcacatatttgtattggtgaattatctaagtattggatccggaaatgtatcagataggataaaaaactacgtaccctattgtccataggcttcccgatgcaaagataagggggagggatattgtacgcaactttacccttgcatatgcaaatagactgtttccagattcgaatccatgaccaactagtcaccaaggcacaactttaccgctgtgccaggcctcgctgaaatgctaactaaaatgtgttgaattgactgaatctgttaatattctctccatgtttatggtaattatggtgctttctacagggatcttggtaactctaacctatctggacatttggtacctgaacttgggaagctggagcatctacagtatctgtatgttttctaactttgctttacatttttttccagatattgtgactttttaagtctgttaaatgtgcccttatgatgcattgacacaatacatgtatcagatatggtacgataatgcggttatcctaaaaatgtatcagatatggtacgttaagatacttatgaacaaaataaaaattgtaaaccattgtcatcataaatcactttctgttgtcaaataggaataaagaggactttaagtttgttatttatgcccttatgatgcataggtacaatgcatgtatcaaatacaaaacatatctgatacggcgatacaattagtaaatatctgatacataaaatatatcagatacaatatgtgaaagatgaatatctagaatggtagatatgtataaaaattcatagaacataataaacatctgatgtatgtggacctccatcaacatctgatacataaaatatatcagatacaatatgtgaaagatgaatatctagaattgtagatatgtataaaaattcataaaacataataaacatataattgcaaatccaaattaagaacacacttcttggacattacaatgaataaaataaaaactataaagcattgtcatcataaatcactttctattgtctataagtaggaataatatcaatctcattcctctcttgagatcatccataaagaggacaatttcattttttgcttcattaagggacaatgcttctatgtttctatattatgtttgaagtttgatatgtagctatattagattatattttcatgactttttttaaaaggcttggatacttcatagatatgtgttggtgaagtatccaagagtattggttttggatatgtatcgtatacgtaaaacaaatgaaagtataagacagtgtttcatattgtgctcatattattactaaaatgattgatttattggtatttgctgtggctctcttattgttgtgaactatcgaattttatacttgttagtgtttaatgtggttttcctttcattggatgtagtgagttgtacaaaaacaacattcaaggaactattcctccggaacttggaaacctgaagagtctagttagcttggacttgtacaacaacaacatatcaggcaccatcccaccttcattggggaaattgaagaatcttgtctttttgtaagtatgtttaataacatattaagcttgactggacagatctgtggcatttgctttcccttctttcatttgaatttcttgcaagactttgaatgatgcaggcaaagtacaagaacttttgcatagcaacttattgacattggtgtttttcagttatacattttatattaagtttgggcatggacaattttgggttttgtgcttggtgttaagatgtggactgtagggcatatatttatgttaagacagatgaattatgacagtagatatgaaatgaattgctttcaaaattcacattctcaaacctaaatataaacctcattcataggaggaaatatcaacaatgttttagttcaaaggaaataaaataatttactatcatatccttaaaataatagaccaatgaagccattaagtaaagcataatttagtccaatcagtgtgaaaaatttctccccttaaatccccccaaccattattgagtgaaagagtgattctactattctagtatgactcattttgattaaattgagatgacttcagtcccgacattcagtggtatgattcaatctaaacaaactaagtaacttaaaagttctatctaaacatttcaatggaccatgtctaagcacaattcaatatccttcacaaatcaaacctctagtcagtgaatgacccatagaaagctatttactttttttaggtggtaaaatacttcaacctagcttttttttagctttcacagagtctgaaatttattcagccaaacctggaagctaagtgacaatttaaaataacattaataaatattaatctgagttagtaatcccattttgaagtgttggaagctgttagtgtttcaatatgatatggtgtaacttacaagtttcttaactggtgagacttttgattattattttgtggaataaatattcagcactttcatgattctctcaactgtgttttctttgcagacgactcaatgacaaccgactaactggcccaatccccaaggaacttgctgctgtttcaagccttaaagtagtgtaagtaacaatcttgtctttatatgttgatcatgataacattaggtaacttgaagatttatgctttcaaagagcctaaacattcactttattttcagggatgtctccaacaatgatttatgtggtacaattcctacctccgggccattcgagcatattccattgaataagtaatttcttcttaactctaagcatgtagcttttttcttattctccatgtggtgctattcatgttggctttcactcgagtcttattttcttctcttctgcacctttttttaatattgttccttccttttctttttcttttttgttggggccttgggggaggtaagggggtaacaatgagaaatttagtaaccttctctgctaaatgctgctatatcacccttgcaatttttattgctcaatggttaagatgttgtgggtgtcctgttcacatcacccttgcaatttttattgcttaatggttaagatgttgtgcttgtcctgttcacatcatatttatggaggtcctgttaaattgtgatgataatatttgattgttattcgttgttgtgtgtgatgatgacacaaagtgtatatgataggcaatttccaattgtttcatgggatagtaggaattgacacagcttttgggaggcttccctgttacaatgtatttgtgatgacagggaatttgattgcattttattgtcctatacagttaattatagttggtcttcctgcatttttctggtgcactgattctgtaatcatttaaattttgccttctagattttagcttgaaaatattttctgctatctggttatctttcttctttcctgttacttgttgaataagcgttgttttgtttcaatgatgtagctttgagaataatcctcgtttggaaggtccagagttgttgggacttgtaagttatgatacaaactgctcgtgaataacgtgatgtggtaggatctcaatctgcgttgaattatatatatgtattctaaaatttaagtgttacctcatagtgtaatgggcagtggtaaatgtaatctctggtatatgtaaatttacatactaagggcattggaatttgtaacaatattatgatctgacaatgatgttgagacttgaatatctattgatgaaatactagggggaaaaaatcgacttggtcactgataaaatatgtgtgacgtattgctctctattctatgttattttgtttctttgtcaatgacaatgcatgtgtttatcgtcgtggtattcacttcacatatgtaacttttgcttggtgtaactgaatatcgtgtgcaaggagacaaattctttaaagatggtttatccctcgtgaattgacgggtaacaaactggttcaagttattttttttatccgtaataaccaaagacaaattaggagatttataataatttttgcatctttattcaatcaactgaacttaatcctcttgaattttgctttaacaaattggttcaagttattaggaatatatatcttgttcaatttaaaaggtgcacttatcaagcaaaggatgcaatgaaaatggcaaacaagacccacagataggagttttgtgttaccttttgatggttcgagttaaccactcagaattttaaatatcattttaaacaacactggaggtgtaataattaattttgggggaatggtttactggttttcaaatgaattggtcttaccttctgaatgtattgttggcttcaattggcaattaactacggaacaaataagctcattttttttactagactatttgtattgtctttttcaaacaactcaccattagagtactcgatgttataattcgtcgtcggaaaatttggagcatttgatgttctatttatatcatgcttgaatcaatcacgtcattaaagaaacgcagtggttttaagacataattgcatcatctcccttgttaactaaaaaagagccccatattttacttggttatgaattggttaaattgaagataaatgttaaccagtgtattgattaagaagcataaaatataaatgtttttgttgtgagatggaaaaatgtactatcaatgatcttttttatgttttcttataaattatataataaatatttttttttcttaattaatgttctaagaatactggttaacaagaccttaaattaaaaatgtcaattttttcgatccttctttttattcattgttcttctcacttatttttcatttttgtcaaatgtatgctcggatactttatttatttataaatcatgttggtattgtagcattcagaatcgtctcacttcaaagaactagagacaagacgttatgaacgcttcaaatagaactagtttcacatgagcacaacgaaacttcaatgtgaatcaaacaattgtaggatggaatgctgaatttttaattatacaattctagacgtgattcaatctatgtttacaagttaaagaaaactaatttctatacttttgcagatttttattcaattacaataatttataattgagcacatatttaaaatagtttaatttgataaaaaaaaagagagtaaagaaatgcatttcagagaaattttgttatttaaataaaatagaagtataaattgtaatttacgcacttacatcaatgtcaggatggccgagtggtctaaggcgccagactcaagttctggtcctcgtgagagggcgtgggttcaaatcccacttctgacacttttgtcatatttttttgtctcctcttttacgtttttaagtcattcctgttaatataatttggcgatagttccagcaataataaatatgcatcacaaattcacaatcataatctgacaacatgaattccatcatatgttaatttaggctgaaatgataactcgactacaagagattaatcttcaactggtgataaatgaccaatggacatggaccattttttgggtatatgttgttatgctgactttgtatagtattttgaataatattaatacaatactcttttccttccaaaaagctatgaaatttacatgtgctgctacataattataaagtgtaatgactaggtacataagtgtaataacactgttaattagtaataaaaaaaaatgtaatgactaggtacataagcgtaaaaacactgttagttagtaataaaaaaacctgctgatatatgatttttatagtaattattaaaattaacaaatttatcttataggataatgtttgtaattaaataatgatgtaagtgtataatctggcccaacttttttagttattgttgaagttaggctaagcttttaattgcattataatattaatacttttgaaaatttgttttggaatagaataaaacagcaatttcatttctaaagtattattttattttttggttgcaattataaagtatattctctcatatagattatatttgattagatattttagttattttttagtttttttattgattaaaatttttgtttaactgatcgataaataagttttttttagtagattttattattctttaaaatgttacttaatttaatgttttttaaaatattacttaatttaactttttcaaaatgataacctctagtttttagttttttttaatatttttttcatttttatctttaatatatttatttaattttctagttatcctttttaaataaatcataattttttttattttacactttttagttacttcaacaactaatcttattgaataccaactaattttaccaaatataaccatactctcgaaataaataaaatacataaataatatttcatgctaccaaaaaaaatagaaataatcttttaagtattataaatcatattatacaacccgtcaagtattgaaaaatctttcaaattatgttctgaatgttagtaaaatatatcactgcataaactaaattaatgaaagaattatctatataattttattactgtaaagaccatttagaagctgagaaagtaatacttgagagaacaaattgatagtttactcttatgaaatatatataatatattttagaaactaaattatcgaatatctgccaattagttttctcccttcttaatttgaaacaagtatattgtgtttggttaatagcttttcattaaagctactatttgtagattctgcatattttttttctggtttatgactcgatgcacatattttacgtatatccaaatatttctaatttttaagcttgaagagagaaattttattctctttaactcttcatctgtatttctataagtggtggaatattgtgaagttagtaaagaaagatgattatactatataaaaattgataataaaaaataatttgtgaaaaataattaaaaataaacatattactcaagaagcaatcttcaattgagaaaaaaaaaaaacacaaaaaagaattgatctttaattgttccctccatcgaaattttctttgaacctctgccattgttccatcatgtacaaactttatgcagacaaactcacaaacgtgcatttaatcagtaatcactttagcttgattgtgggcctaagtcttactttatattgccaatacaacaagcagtaccagacacaaactgggctgaaaactaccatttttgacaaaaaaacaaaaaaacaaaaaccaaaatggccattgtagtgggtccgtaggtagaaaataacgattgcaattggacccagagcgataaataaaaaacaattttatacaaaatggccacaagtagccaagaaaaattatttcacatacaaaagacgtgggtaattaactaactttattttaaaatatatatttttatatcaattttaagatttttaaataataatctcgaaactaaacatgcatttaacgtcctaaacacttattacccaaagatgttatttccttgttaatttaacgttaccatagtttttctgtaaagtgtatatttgctttagtgtcacgtcagactcattttagatgtgtattattataacttgggtgttattttaggtaatctttaatggaagatgtttgatgagtgagacaaaagcacacatacgcaagaagttggcctctcctccaagcaattcagaatttcaaatgggttaacgaacctcaattaaattaaacaaaacatacatcgtgtaattcttctctcttaaggcatatagtgaaagggcatatcatatgcttgcttgatgtaccaatctccctcatgtgatttaagtatataaaaatagaaaatgaaatatcttgcacgtatggatccaaatttaaaattaaagtaaaattaattctttcactctgttgtctttaaaagacctttggtaccgttaatgtttgtgcttacatgatatgttattttccttatgtgcaattgatggtgcacacgttgataatatttgccaaaaatatgtcaaaaaatacatcatgtttttatatatattctttatcatactatttaacccatcacatgtttttttttttcttttttttgtgtttatctctttacccttttgtataaaatattataaaattaacatttgtctaagagatagttttagattaattcaagaataaaaacaaaaatttataacgcaaaagttgaaaaataccacattgcaacgtgttgaatgtgataaattaagtctacctctctataatgtattgcctcatttctctatatatacaaacccactcgcaagggcctataatgccacaacccacattgtggatcaacagcttctaataaatccttgacaacttcctccacttctaattcaattcaggctctagctatgagcaaaagcaataacaatataatgagctttaaagctataaccttatggtgcattttgttgtctttgttgcaactatcactaggagctgtaatgcaccgcattaggtttaatgtagagtacatgtatcgtgagccagattgccatgagcacgttgtgatgggaatcaatggccagtttcctggcccaaccatcacagctgaagctggagacacccttgagattctactcaccaataagctctccacagagggaacagttattcactggcatggaattagacaggttttatatatatacttttttgtccctttctttctctgtctagacatacatatagaaatatatatgatcgaatattaaacttgtacacttttttggggtgtattgtgtatgttgcagtatggaacaccttgggctgatggaactgctgccatttcacagtgtgctattgctcctggagaaacttttaattacacatttacagttgacagggtatatgcatactaattaaattacgtttatctctttattttgtttcgtgtgctagctataaatacttatcccttaaaaaaaaagctataagtaattatggcatatgttacattatctttattttgaaatattaattttagttcctataattagtccctataattatcaaaaagtgatatgattttaattagtcttaaattaggaactaaaaatatgtgtttttggataaaagtagaggccgaaaacctattaaatttctatatggactaaaattaaacgtggtgcaggcgggtacatatttctatcatggacactttggtatgcaaagagcagcaggactgtatggttctctgatagtgaatttgccaaagggaaaaaaggagccattccattatgatggtgagttcaaccttttgctgagtgattggtggcacaaaagcacacattctcaagaggttggtctctcctccatgccattcagatggattaacgaacctcaggtaaatcgaatatactccaacaccctgaactttttttatattttttataattacacacgatattactctttttctagctatttctgtattaacccctttaaatgtttgaaaaaatattatactgacaattattacactaacattcatgtaagaaaagctgttgtaaacgttaaaaaatgagaagtattgtgtgtaatacgaaaaaatctaaagaggtgtggtgtgtcattgtaatttgttttttttctttctcttcattatcttatatctgaattaacagtgaaatagagaagaaatgcattagaagaaaataaatagaaatgataaaataaaagagaaataaagtgaaaaatattttgttcggatgaaaagaaatagtatttttatattatttttgttttcttctctcatgttgttatgtgaataaataaacataggattattaatgatgtataaggacatatcatatgtcagcttatctcccacttgtgatgtaagaatataaaaatggataatgaaatatcttgaacgtatggatccaaattcattgcagatcaaaatctaacctcgaaacgaattagaaacacatgtattgtccttctccctgctgagcaaataggaaaaaagaaaacatatatggactgttcatatctcccgctagtggaaagtgggcatatattggatttttgtgcaaacaagtcttctccttagctaaatcaacatattcaattttcaaccagaaattcatttactttgtaagtaattaaggaatttccaataagaagacgattagattttaacactaatgttcacgataatctttattttatgcatggctatatgtcttttttttttttataaacaataaatccattgccaaatcagcttttcaagatactatagaggtcccaagatttttatataataaaataaagctagctcttagtatttctgaaagaaaaaagatatataaattatactatcttatagaagaaacatgggatacgcccattcgattttgtctaatagcccggtcacaaaatttaatatttatatataagaatttgattagaatttagaaatagtatacatattttttatattattgtttaactaagaattctcatgtttagtaagatggttaagttttataataattatttcaaaaatcatacacaagtgatttctcgttggcaaacattgtaaatcattttatattcacaatgtatcaaaatttttttttttacaggaccaaaattaaattctttataatacaagagtgttaaatatacatcatatctagaaaagtatcatgtatttgatccatttctgtattcaaaagaaattatagtcaaaatctcgttaatattactattgaattttttaaaaaaactaactcaataaaaaaacatgaatctctaaacaattgaagaagaagaagaagaatataaaatgtaaactaatatttataagtagagcgatttttgtaagcccttaaaagactgtttcagttttccgttttccctttcctattgtgaccaatttttttttttttttaaatgattgtaattatttcattgttacttgcaaatattattcagagtttttaattataaccattataccgattttttttttcgagagatacaatgtcgttaagagtgataatatcttcacttgttcctaccaacaatatggttcaagtgactaggggctaagactaaagcacatggtcgaataatgtttgatgtgtataaaaaacattttaggaagaagacaataaacttatgagtgtcactagaatttttagaaaaatttaaaaatcttgatgatcgacagtgatactcatttgcaatcacatacataaaaaaaatattcattttttccacttaattatcttttaatatttaattcactccataaattaacaaggtgagaatagctctagaagtagaagtagtaaccaaagaaagtcaactacactacttcctttagttattgttgtacctatgcaagattccagccaatagatatttgaatggaaagaattttcttacctttcaaacatttaactttttcagtctttgcttattaatgggagaggacaatacaattgttccttggcagctaatcttattaagacctccttgccccaatgcaagttcagaggtaacgaacaatgtgcacctcagattctccatgtcgatccaaacaagacctacaggatcaggattgctagtaccacttccttggcatctctcaacttggccattggggtaagtttattatcatatgtatattttatttcatgaaatttatattggtagtagcatgcatcatgctagttttatattttatgttttggatagcaactagtcttatattttaactatttttaatattgttagcaataataaaaaatactagtaatttgaatactttttattaccaattccatagaaaactttttatttttagtttcttaaccaagttagcatttgcctattaatatcaagacaaactctatatataaacctgcatgcgacgcatatgtccatgaaaaatgtcagagtaggctaactttaataacccgagttccatacagcatcttatcttgaatatgcaaaaaaaaaaaatgtttatgtattatgtagtataatatataatataattatttataaaagcaactaaaaatgtgagttttatatatttttttattcttttctacacaatctgatggtaagtaaaaggagatgaaagatgccaacttaatgaaattaaaataaggaattttattatttaaattaaatatgaaataattaatattgtatttgatattatatataatttttttattatatatataaatctaaaaaatctactagtttattatttatatttatatatatatatatatataaaagaaagttttattctataggataatgtcatgtaacatctcatattcattccctccaaataatttaataattcaattaatatagatttatatttattttattctatttgcaatagaatcttaaattaattagaaaatttaaatcaattatagtacttaaaaactgtataaattatatttttacatatctactaacacaccattattaaaatttaaactaaataattaataatatattaaaagttaaataatataaaaattattcttataaattataaaatataaatttaatactcggagaactaaactagtattttttttaaaccaataatttattttcgatgactaggaaaaataaaaaaaatgttgcaaaacaatatttccataaaatatgatagagatgtcactgccgctgtactctgtagattggtcgtgaacgtgaaagagaagacaaaaggtagctcttgtcatttttaatccctggctcaggcccagaccccatacttttgggcacatggttgcagggattaacctttggattcttcagttttgggacttgggaggaactataaaacttcatcacttaataataaaaaagtatctttattcatatttttttccctcaatttttcttcttcttttcaaacactacacaaagttcaacttttgttgattgcacgacgatcggggaaaaagaaaaagaaaaaataaaattgtacaagcctacgaggacttagtttctgttaaaattaaagtttatactaaaggttttatatatgccatgcacaccgtatagttgaggaggctataataccacgttaaatttttttttttcaaaacattaagaaattagttattaatatttttttaaaaaaactcaagagatactattatctattaatcatatcacactattaataactttaagttattatgttaaatgggtaaaatctgtaaaaaaatatattaaatgggtaaaaggttttatatatctggcataactttttttctgttatcgaaaaatcgaaatgcctaatatctttggatttcatccatttttttaatctttaatttaatattgaagttttggtgagaaaacagagataaccaaattctttgtgttagtatgtagaattgaaattgatactagtatcatttagacagttggttacctagctatgcatttgcactttacgtcatgattgaattatacttagtaatccataatcttttgtaaaaactctacttcaatatgtatatgtgcagttgtatatacgtaattagtttcagcatgaagaatgttgacatgtgttgcatgcttttaacttctttgtgcttatagaatcacaaattggtggtggtggaagctgatggaaactatgtgaaaccatttatcgttgatgacatagacatatattctggtgaaagttactcggttctccttacaacaaatcaagacccaaagaaaaactattggatttcagttggtgttagaggaagaccacccaacaccccacaaggtttaactatcctaaactacaaaacaatctctgcctcagtttttcccacttcttcaccacccatcacacctcaatgggatgattataatcgtagcaaggcattcacttacaaaattcttgccctaaagggaacggaacaacctcctcaacactatgatcgtaggcttttccttctcaacacacaaaaccttgttgatggatacactaaatgggccattaacaatgtctcactagcattgccaacaactccttacctaggctccattaggtttaatgtgaatggtgcctttgacccaaaaagtccacctgacaatttctcaatggattatgacatcttgaaacctcccttgaaccctaatgcaaacattggaagtggggtttacatgtttcagtttaaccaagttgttgatgtgatactccaaaatgctaatgtaatgaagggcaaaaacagtgagattcacccttggcatttgcatgggcatgacttttggattttagggtatggagatgggaaattcaaacaaggtgacgagtccaaattcaacttaaagaacccaccattgaggaacactgcagtgatattcccttatggttggactgctttgaggtttaaggcagataatcctggagtttgggccttccattgccatattgagcctcatttgcacatgggaatgggtgtcatttttgctgaggctgttcaaaacgtgaagagtatacctagggatgcttttgcatgtggcattctcaagatgttcatgaatgaggaacacaactgaaactagcagatagccacacatgtgtttacccttagtttgtttagtttaactttctttcttgtcttcttcccttcattgttttgtttctgtagtcttgctgtgcttttattgtgtgttagctaggcatgctgactacctcatgtaaggtagtcgtgccttgttctactaaaaaaattatggtaagcatgccaaagaatgtgaccgagttctgctgcttttactaggcaatatagtataccatttaaaactttaaatgagatcatcagatgcatattatgttcaataaataatcatagagtgagaaacaattgaacacaaacaagttttcaatacacatcaacaacatttttaatccaagttaattgagttccatgatagatgaacccaataatatatatgaggaggttgaaaaaaaaagaaggtaaaaacaaagaaagaaaaaagaagaaaagagagatgaagagaaaaaaaaaattaaaaatgaactatataaaatatagagataataacagatctaatcatctactaaatttataacttttctcattctctttgaaaacacaacaaacaagttttcaatctcaataaaataataaccaagatttattcaccagttatagcccaaatatgagttaatatgcatattgtagctctattaaaaaacaactaataaaaccatttattatagttttttttaatgatttttctatagaacaaattttcacccgcatgaaaactttgtgctgcctatgtaacataatttcaatcctcaatgatgctcttacttggtggcttgagcgattatattactcaatgagctggcttcctctttggcagtttccactaaatcctcctgtaactcattatcataagatcagaattttgtaaaacacaagattaattataaaatatgaggataaaattaagatgcaattcctttgttgtttttactgctattctttaactacaattagactttcactttagtaacttatgttgagttttagtgtacatcctaatgtaaatgatcaaaatcagattctattgtgattaaagactaccagaaaaaagtactgagagcattacatccaaattttgtccaaaatatgatagttatggtaaactaggagtggaaaatgtaataagaaaaattacctgtgcacttatcaatctcagagtagttctcttgctagtctcctgcatggctccagccaataaaatttcatccaatataaaatatgcctgccaagatcaagcacaattttaatcacggatgaagataaacaccaaatagtacatagtagttttcttttctttcattaaatcattagcattcttacttatatatgactttcaaatttatattaaaaataagaaaatatgattgatcacaacgaagactgcaatcaaacctgcaaggatcctagtcttatttaccgtataaactatataatgtaacatgatattagattatctgatttttttgaggggtatccaatattgttgaactgtgtgcattattagaaagaatacagtctgagagaaaatgaattaccttatgaaaattaaagattaaatccagctcacaaacctggtaatagaagtaagagaaacaaactcaggatctgaagtacgtgtgcaaattattaataactttagaattcaacaatttacgatactaacactgccaaaataacgatccaatgtctcaacatagtgatgaataatggccaaggtctccaattcattgtcttcgtgatcattgcaaatgcaaaagtataggctagcatatctaaacaataaccaaaatgaagagtctgaaaattattatagtttagtgtattttgttagccatgcatcagctgagggaacaatgaagggaagggatcaatcttgacccaccttttataaacaactttgaatcccctccactccacgaagttgcacagcttaggggctcgagagataattaccccagttaactcacgaattaccttccataaaataaagacaaaaagcataaatagaattaaaaaaaataaaaaattaagcgatgttgtatacccaaaagacatcaataagcaaaatccatttcataggacaattaaccgctataagaatatgatccagtgcatatatttaacagaacatgcataaacattaacaattgatataacatgaaatatgcctaaaaatatcaaacaagggtcactcataataaaatatcattataaatgtagaaggattgaagccttgtcataatttagattcatacttatagctcatattcaacatgcaattttggtgataaaaccatattgaatactttcagatccaatgatttgtgcaattctaactaccatgatctaacacattgggtcaaaatagattaaaccatttacattttatattgaattagaggtaagtaccttggatctctccttttgagagtatggtgaataccattttgcgagccttacttttccttgtcgactgatgagaagcacaaagtgaatctgtaaccaaaaagaattattattatttttaaatctctaaattataatatagatgtacgcatacacatgatttatataatttcaaatcaaacccatcttctcaagaatgagttgtggatgatattaagccaacaccataaatagtgacatcaaacactgcacaaaacgaggttaggttcatcgaaaggaatcacgtaattttctacaaatacgtaacatgaatttcacttattgaaagaaaaagatgaattgcagtgaattgaaaaatatttaaaaactgatacaacgagaagaaaaaacatttaccattgatggtcgatatgggatttgagaagaccacaaatgaaactctttaagattgttgtttttcacttttcagaaaggaataaaagtatttcaagttatgatgcgttaaatatcaaaatcatatatgctattaaatatgagccttattaattgttgaggttaaggtcaaagttaaacatttaattagtgtcacacaaattaatgtgtatttgactgttttcttttaaaaaagaaataaactttgaaatatggatttgttatatatacacaaaattaatttgttagttagaagtaccatacatgcctaataattcacaaaataaataaaaaataaaatacttgcctaaccattgttttatgtgttaggatatttttttgtatatgaaaaccttttcctggtttctcctaaatgttgttatacctttgtaaacacaatgtaagagtttttttttttttttttttttttttttgtgaatacaatgttagagatcaggatcacacaatcttgcatattataagatgatgattgatgcattaaacaagatagtacataaaatttaccgatattatattgacgtgtactaaacttgtcacctaaatagttggctggcaagatatgctaccactctttttatttaagttttcatttaggatgaataagattaaagaataagatgattaataaatactatattttttttttcatttggttgatgaactcttatagactcatacaatcagtggcccaaatttagataaaattttggaggtcaatgtcattaagatgataacatataatttaaatgcaatttttttataatatattctcttaagcatttgatattttttaaatattaattatgttaattaaatatttttatattagaatatttttctactttattaaccatgttgctcaggtttcctttttttttttttataggaattttacacccatatctaaatttcatctttagaatagaataattaattagtgacacaagtgattttataggtggtacatgcaagagatcttatatatcctaaatataggattttcaattttatctttggcattaaaacttctaaataaaatgtgacgagtattaaaaatcgtcatattgtttcaaaacttatgagactctgattaataaaactcatggaccatctaagtgttatatataggatttcaaaacttataatcctatttttattgaagaaacgtcatcttataatcctatctagtaaataccatctttctatctcaaatgtaaattggtaatgacacatttctacgtccaaatctatatatcttaaatctatgtgttctttctaaagttgcctcttgtgcaggtcatccaagtaaggatgtcccattgctttctttgcagaaatcctcttgcaaggttcatatttcaacgttttctgaaaagaaaaagagagaaaaatataatgaaatgaaaatgaacagtaggcactaaaataaaaagaattagctaaggagcaacttaaacttaacaaatagaagatccagtcaagttggaacaatcattgagagactttgaggattccattggggctactcatgcaagttccttggtttactcactcctagccacacctcttcattaggagtacccaatagcctgcacaaacaagactattaaattagaattatatatacataatgaagctaattaagaaagtgacacacacatatatctaattgttaaacgaaagcggtctaagaataaaacaattaaaatttaaaatttaggttttcaacaaaaaaaataaattactattaatttttataacacaaaaaagattacatatatattaacaaaaaggactaacataatttaaaaaaattatcttaaaaattactttaggcttcaataaccattgagtcagctctttgttttaaatcataaacctcttaaaaccctatacctgaatatatgaaggagttgtcgctagggatgaaaataggccaggtcgcctatcaggggcttttggcctggcctgacttgtttattataaaggataggcttaagcttttgaaaagcctatttaaataaaaaggctgggcttaagctttaaaaaaagcctattaggcctatcaggctggcctatatatatatatatatatatatatatatatatatatatagatattaaaattaaaaagatataaatcaatcttttaaaaaaagaaataaaataagataagataaaatctaaatagcttatcttacttaaaagataaaaaataaaataggaaatttgaaatctttgtagtaggtttgtaaaaaagccaatatatatatatatatatatatataaactaaaaaaatataaatcaatctttaaaaaaagaaataaaataagataagatacctaatctcatattagagtgctctaattaattttatttttttcacgcacaaattaaaagggaagtatgtcaatatgtgtctttctttatattaaattctaaaaaatattatgcgaattctcaaagtttcactaatatataatatttattgtaaaatagactttttaataggctcgtaggccaagccagacttttaaataggtcaggccaagcctaaaaaaaaagcctataacaggtaaataggctaggccagacttgatgtttttaaataagaccaaggtcaggcttagtggcctaaaaaaaagcctataacaggtaaataggctaggccagacttgatgtttttaaataaggtcaaggctaggcctaactaagcctgacctagcctgacttgtttccacccctagttgtcgcagctcggaatcacctagaaagagtggttgtttggtgacaagtttcagctacaattgagatgcgaataatattattagaaaagcctctactactcttcctaatatacaaacaagaagatccttaaatcctcatgtccttaccaaatatgcagctaacggaccacatgcatgttcactactgttgactgttgagtaatgggtagctcccaagaggacttcaggagctctataccgcagggttagtatctgaaaatagatacatatattggcatacacaggtttaatattaaccaaagtagagaaaaatagacaaaaaaaaaattgtctttttacctcctgtatattgcttaattggcactgaaaatgtttgagctagtctaagatcagctattttaagcatcactgtttgtcggtccttaagagcaagagattatgggacttctgttttactttattttttttatctataaatattaattgttaatttattaattttttattagtagaaaaattaaactcgtgattttttcttcttcttattttttaaccatccaatcaattttatatatccttatatgctttaattcccttaataaatgaagattcaatttacaggaagactatatatataatatgtgcaagtgtgagcaagagaaatgaaaggaaacaagcaatgagaatatgttaagtacctgtgcaagactccatgaccgaggcagaaagcaatgcccttgcaaagttggtacatcaagctctgtaaccaaccaaattcataacattgataaaaaaaacatatattgattgaataagtttaataattaatcatttggtgtcaattttgattttagtccatctgtttaaattaaaaactctgcattttcgtctttatataagtaataacttaatttttaaattttagttcttgtgttcctattttatgacgattttacacctctgttagagaactaacaacatggactaaaacataaaataaattgcttatacatatatattagcattaacaataaccaaaatacagcgccatgcccactctgcaagagatgagtgctcatcaattgtttagcacttggcaactccaacagtataaccacaaaggttgaatatatcaatcttctcactgacttgctttgtttgaacatattctgcagtacaagtataacattaatatattattttgtatgacataagaagtaaaaataaaatagaattgttgtatatgtccctttttaattcataataggaaatatatttattaattgtttaacatatgactattattcttcaagttaagtgtactacaacacaaatcaaattaacatttttaattataattttatcacagttaatcctcttcaaaattacatgttcttaaatggaaacaattatctcttgcacctaaataaacaaaaccttagtacctcataggggatgagcggttccgttaaaaaagaagtgagagagatgcattgagcgctgaagagctttggcagtgtagagtttaagggtaggtccttatataagtgacaagtgtcctcttagacagcctgaattatattaatataatattaatagatagatagattaattaattcaatattatttaattatattaaaagatagcttgggaatgtggaagttattattgtctttcttgatcttttgacatgggcattttagttttttatttttcttcttctttaatgttataaattattatttaagaatatttaaaaattcaaatacacataatttaggaatataatcttaacctatataattataggcaaatcatttaggtgtcttagttattatgtaagaatttaacacaaccatatactataataaaaattataataaatctgttgttatttaactaaatacattactttaaagtgttttattaacatgtgttcttagatattgattaaaaaattaaaaaatatttattacaaaaagtcataaaaaatataaaaataatcataatatatatatatatatatatatattaataaaaatatttatactgttaacattcttaattaattcgcttgacatttgtctgcttcaaatgagatttgtaacatgttaaacaaaagcttgtattggtgtctgttactaatgtaagtggacttttgtgattggtcatgtttcaataatatacgatacgcacacggaccccacacacaactaaaataaagtaaaaactaaaactgaaacttcattaatcatattcacacatcatgtcataattaatgatttaataaatactaataaccgatttcccaaggttaggatgggattaacctaaccaatgttataaatatctctgaaacttgaattactccacatatttgggcttttatcaatgttttaatcccaccaataatgaatgacacccccactacacgttcaccaagagcaccaccataagcaataataaaagcaagataatgctcaacactctgttccttttctcactcactctttcttcccaccttcctctccttcttttctcttctttcttcttcttcttccatctctttttttctgcttaaggtctacaaaagttcttcttcttcttctccccctattcacctttggtcttcacacgagaaaacccacttctggatcttctggtaaggttcccctcatgaagaaaaaaatctccttttcattattcagttccttcttgattgctgcttggtctataaaattctggccttttttttttgtttttgtttctttttttgttgtgtgttttttcttttttttgttggtactaattttacactatgatttgctatgttctagtctttttcttagccttctgaccttcagttgacacacacacacatatatgtatatatgtatatatatatatatatatatatatacatgtatgtatgtattctttgctgactgttgctatttatagtgttttcgggtttctgagtgattggtttggccttagatcctttgttgatggctggtttgatttgtttcctcatctgtattgggaaagaaaattttgaaacctttcagtcgtcatatgtttgatgatgggttgatgagcgatgttttcatttttaaataatcgttgaaccatggcatgtgcttttggtgcttgtattttgactattttcatttttaaatttgtgggtgatttggatctattcaatcagaataatcctgatccaataactgttttgatgaatggtgttttagggggaaaaaacgagaattttgagatttcatttagtgatatgatgcgtcgatgctttaaaattattgatgtatttgtattgtagctatgcaacataggtgataagcaactttagattttactttttagcctatatccaatatggctggatgagaatgaaagaaaaaatgtgctggtgaaaattgggttgctagtgaatctcatacaagatattgacatagattttatgcttttgaattttgatattcgcttcatctggaaagtatcatttgatctttgcaccgtctcaattgttccctgtttttaacttttggcaggtgtaaaggccattagaagctttagaaattttcaaattgagttggtgtatagtgttgaagggggtgaaatttggagcccagtttgttactcacttcatttgaaagctcataggttaaaccctctttttctggagatttatctgggaaaagatgatgatgtttgaagatatggggttctgtggcgatttggatatgttatgtggttctcttggggagggggatattgctgtgaggcaaactgaaccagatcctgtagttgaggatgactacagtgatgaagaaatggatatggatgaactcgagaagaggatgtggagggacaaaatgcgtcacaagcgattgaaagaacaaaccaagtccaaggaagggactgatgcagcaaagcaaaggcaatcccaagagcaggcaaggaggaaaaagatgtcaagagcccaagatggaatactgaagtacatgctgaagatgatggaggtttgcaaggcacaagggtttgtttatgggataattcctgagaaggggaagccagtgacgggagcatcagacaatcttcgcgaatggtggaaggataaggtcaggtttgatcgaaatggtcctgctgccatagctaagtatcaagctgataatgcaatccctggaaagaatgatggatgcaattccattggtcctacaccacacaccttgcaagagttacaggacacaaccttgggttctctcttgtcagcacttatgcagcactgtgatcctcctcagaggaggttcccactagagaagggtgctcctccaccatggtggccaactgggaatgaagaatggtggcctcaaattggtctacctaaagatcaaggccctccaccttacaggaaaccacatgacctaaagaaggcgtggaaggttggtgttctcactgcagtcatcaagcatatgtcccctgatatcgccaaaattcgcaagcttgtgaggcagtccaaatgccttcaagacaaaatgactgcaaaggaaagtgcaacctggcttgccatcatcaaccaagaggaaaccttggctagagagctttaccctgactattgccctccattctcctctgctggaggtaatggatccttggtgatcaatgattgcagtgagtatgatgttgacggggccgaagaagagccgaacttcgatgttgaggaccggaagcctgtccatcttcatccatcaaaccttgggatggagagaatgaggggaaggatgccaattcagcaaccttctcatccaatgaagggagatgttgtcacaaacctagatttcatccggaagaggaaaatttctagtgacttcaacatgatgatggatcagaaaatctacacatgtgagcatccccaatgcccttacagtgaagttcgccttggtttccaggataggtctgccagggacaatcatcaattgaattgtgcatatagaaacagttctgcagattatggtggtggtcccaatttccatgctactgaggttaagccagtcatatgccccaagtcctttgttcaacccaacactacagctcagtctgcaagtttggttgcaccttcatttgatctaactggtcttggagttccggaggatggccagaaaatgattagtgaccttatgacaatctatgatacaaatgttgtaggaaacaagaacctaagttccgccaactgtgtagctgtagaaaatcataacctttctcatgccagcttacaacaacaggacagttttttccccggtcaaggaatggtgttggaagggaacttctttgcacgagaggaaggtcaatttgaccggttcaaggccaccatgaacatgaatatgaacatgaacatgaacactccttttgataccaaccacaacaataataatatccattcgatgtttgattccccttgtgatttgtcatcctttgatttcaaggaggatatacaaggagtaggaatggattctcttcacaaacagcaagaggtttcaatttggtaccagtgaaaatgacaagagggaaactcgtgtatcatggactttttttgtgtcattaaagggggtcatgtgaaagtcccttgactcaaaaggcagttaatgcatttttcttcccatgtaatcgtttaggtcttagatattttatgatttggtaggtctggtatgggggtattatattatgggttaataaatcatgggtgttcccataatgtaacgctttttatgtgtctttttgtgttagccctatgttgttacttactatcatatgtacgactgtgatataaataaaaagatttttattctcttataaaatcatagttccactgctacattcatagttaaggaatctgaatatgaggctcttttattatgggaacaacaattagattggtggatgagatgagagaaaggcaattggcaaagcctttgttgcattgcatctttctctcattcatctggtgtgctgtgcttcttatcttttcacctaaaaaatggtcccatccaaagtttgtttggcatatgccaaattacattacatggctattcaattgcgtgatcatgttgaatgtgtgctagtggtgtggtggggtcttttcaaagggacacgttgtctttgtctttttgtagtcggcagtcaaatcctttggcgtgctttggaatggttcctcttgagtcttcattgaaagaaaagtgccaatttacgagacaatgaaaggggcacatctcttggatagtcttagctcaggctgctgaatttgcacccaattctcttctctgtcctagttaacgtgccaatgccacattaatgttttggaaagtaccttcatttcttacatataaggggcatgtgtagataattatcatgtgaagtggcacaattgtcaccaaattcagtgaggtagcgaggtggtttgaaagggtagtataactaattgcaatgtgttaaagattgcatatggggaaacccacgtattgtaggattagttaggggtggacatagtctgatttatccaataactcgattaacctgaactgatttgaagaagaaaatctaaattggttttggattttaaaattataaacttgatatttgacgaatctagaacctgaactcataagggctttaaattgtggttattattgtagttgcaatcatgattgcgatcttgacgtgattcttgacattgtaaaaatttgtgaaaaaatatagttaacatggtcataattgcgattgtaaggagattgattattgacattgtgaaaaacacggttgaaatggtcgtaattgtaattgtgagaagattacggtaaatccataaaccttttatgttgtagtcgcaaattcagttgttgatcaatttaaaaccatgatcaatttttttgaggggaaaaaccatgattattagaaatatgaaaatagaacatgacataaaataaaacgtgtagttgaataaaaagtacttagtgaacttaaaaaggaataaaactagtcagtaaagaaacaaaatttgacaaccactgaaaaattggagacaataggttaaaattataaaaatggagaaaacaaaaagataataacactaaatatatacttgttatgataaatggtacctattctcattgaaatatttttaaaattttggaatttatacaggttaatataaatttatgaatattttttcaaatttattaatttgcacccacttctccttgtgcttagtttacgtgccaatgccgcattaataatctttattgttttgcaaataccttcatttcttagatttcgggggacatgtgtggtaaattatcatgtatagtgcacgctacatgtttggttttgtagagttttttttttttttttttttttaaataaaatatgcataattttcttttgatactaatttaaactcaaatttatcttttaattttatttacctttttatcaaattctaaattaatcaaaatctattttttctaatgaattagagaattaaaaaaaaattcaaatttaccttaggattctcttatttatgtttttgcattaaagtataatttttcattctgcattctgcaacaaacattaatttatcaatttatacaagatacatcaattaatctacatagttaatgtatatagatatgttcaacaaattgaaaatgaccccctcgataaaactaggattttgtgaacctctcagtcttaactagcaaaatttaaaaggaaaatattacacttgaaggatctgattctccgaaagagaaaagatactaagtacatcttacttaaaaagataaagatcatttataatggtttgattaaaaaattaatatttaagattgtgataaaaaataaaatatatagtatacaacaaattttataagtaattataattataattattaattttctaattagctgttattaatatatactaccatttatcatttaaagtgtactctccttccttagacacaaatctcatattgaaaataccaaagtgtaatcaatgttttctttcttaatagtgaaaataacttataaaactatagtacaaaatgaaaattgaaaaaaaaataaagtgaacaaatctctctccgatccctttcttgtcggagagtttgcttagctaaaagatttaaaaaatggaaaccattcactgtagacttggctgctaataacttagagacgtggttgactaggttctatgtttctaaaatctaaattattggtgaaaactataagggtctagcttactatgtatatatacataaattaaattatggctaatagttaacgatctgaatctgatgtaggtagcacactaagcaagaaaactctaggatcccccagccactgcttttgcttagttttgctttgtcttaaatacaaaggaagacagcggcatagctggccatatgcatgcctttcttgtgttgcatccatgttggactacagagccacaaaatgatagataattgcagcagaattgtgcgtacatgtgtgataccttatattttcgaaaatagcaatgtgtgccacagtttcttgacttatatcacttgctagttgacagtttctcaatatcaactactatagtatttgatgattgtgtattatagaaacaacttgaagcctaattgtttaattagaagagagtaaatatatagtgtgtatgcatgtaaggaactttattctttcatttaattatatatggtaaaattgtcttcactaatattttagatgtgataaaagttagattttgaatatggtttaaggaaaaaaaatagataatgtatgttcagtgttcttttttttattattggtgtataggtttggaagtttctttctttcttttcatttgatatgatttgattgtatacgggttaaagtgtgacttgaactatgttttctaatatgtaaaaaatatgaaaaattataatagttaacttcaaagttaattaattatgagtataattgttatgtgtttgatcaatataaaaattttacattatcatgtcagttagaaataactgttgatataattttttaaaataattatgataaaaaaattaacaattttattatatataataatttataattaaataatgatggaaaaaagtattttatactattaatacattacatacactatttattcaatataaattctaattgatttactgtataattttttttttcaatattgagatcatttaactcatttgaaatgatgagggggtgtagataaaagaaaccaaactttcaatattgaagctttttacttaattattgaagccacgtcgtagaatttaattaacaaaaaattgaagtggggtatgctatagtaccatatctgtttttctacacacattgtgtgacaacaggaactttcacatgtcacattgtagattaagcactcatgcagcccacctttcccaaaatgatagctcccttgctagtggcagcatctcagcttaaatgcgatatgatcatatagatgttgatatatggcaactccatatgtaaaaaatatgtaattcttttctttcacctttttgagttactcagtggcttctatgcttatccttttctttctcttttcacctaaactatatatctttaaaaaaattattcgtggcatcaaaatattatatatggagattccaaaagtgtcaaataagtcagttctctagagagacctcttatcaacagcagttgcttctagattgatttcaaggattggctattggctaataccaaagtaaaaggatataaaagttaactagtttaaaaggtttcatgtgattttcatgttttcttttagtgagatcctgatttaagcatctatctgttaagactaaagacttagtttacaatctttccagttatccatactatttttacctttatataataaacagtttgcaaatttaagccaccaactttactgacctattttctttttttttgtttctttgataaaattgtaattagtgacaaccaattaattttatatatgtcatgttgaagtgggatgcatatatctacaagccaaaataaattattgggggaaacgatttccaaacaaagggaaattttgaaatatataaattaaaagtagcactttatatcaaaacccttctagaaaaaggttaagacatgaaataaaagaatgtgagttttgttttgtagctccacaagatgcaacccaccaacgctccataaggtagcctagttttttcaattattatattgcagctgaaaggcatcttgaataagaagttgaaggagatttttttaaatttttaaaaaaaagagagttgaaaagatagttaggtatattgaacgagaaaagagaataagtggaagagagagaaagcatagtggaatattactagaagccgaaaaacaagaatgcctatggtcctatgcttttgaattttgatgctgcaaaatcaagtagaaaaatgttactattgtataacaaattttacaatgaagtaggggagagagaaaagaaaaatataaaatatgattaataatctttttttttgtcaatcagggtattaattaataatctaatagaaagagagaaagaaaaaaatatgattatataaaaattgttatatgaataacaccacttaattaaatacgatgtcagctaagctgttcaaataaacaaatattctgcagtataatatgcgaaaaaacatgcgcaatttaatttgtataatttttttttcttgattttgtgcagtgtattacacgtataatttcagaaaccttaaagtcaaaactagcacatttagtcacgtctctatcattaatccactgttaaatcacggatggcatattaccatcaacgtcctagtcaaaggatactaataaaataccaaaaatgatataatattaaataatacaggaaatgtcctaatcatggtaagaagggagggaataaaagaagaaaacaatagtgttccctcttttcttgtgtgactggaaattgatgatgtgagcgtttcgatcaagaattgggaactgggcccgggcccaggcccagtaagatgaagattacaaggccagtttttatttttttggtgggcaatgagagtggcattgtggttaaaaacttaaaaatttagaattaggtagtgcatcacagtgggaaaaggaaacgtgaaaacaaatcaaacaaatatagcaaattatcaattgatggcttgactaaactttctagtttctagccataggattgactcacctagtgataagatttggataatttgcatcaatcatatttgtcaccaaaaaacattgaagtttctaattaaattaagcaattgaggagttgattataatgtatgtttgcaatatcaaattacatccatatgttatggaaggaattattctctttacaacatgacaaatcaaagttacgatggagttgagatttgacatttgatagcaaaatattatgatggagtgaactttaaaattcaatgagtctcacaactttctctttaagtggacaaagtatttcttacttttgtgctcttaatgcaaaacaatataacatttccttttagccaactcacgtgtagatttttccattttgggcctataagatgatacttttaatcaaagaattttacttttttatttttattctcttaaactaaacaatttatcattctactgttctatttttcttttctgtaagtatctttattttattttttatcaagtttattgttgctaaatgtatcattctactccttatcgcactgcatatctttattgttttcacttgtggtcatatttgcttgcatttttttgcctctggtatgttagttttagtatgagatggaaaacaatttgatgcactataatgaaacattcttcatttcttagtggagttcttaatttattattagttgatacatttagcaatttatcttttacttttaatttttaagtttgcttatacaataattcttaatcattaaacattaaaaatattttatgcaaatctagcatagcacggcggagcgaagcggagccgtcccgtgcgtatgcgtacgggtactgtaactagtttctaataaaaaaaggaagagactaaaagtgcttggctgatattttttagacactactacacaatttacttattgggccgatattacatgttaaattttggagcactttagacattggttggcccagaacaattatttttcatttttaaactacgagaactatataatattataaaataaaaggaaaattaaaataataaatgtattttgatttattattttatttttgttttgaaaaaaacattaattcagactatttattgcaaaatagtttttttttgcttctattatttttctctttaaaattcaactctaaacattctcgtaaaatccttgttctttttggaggagtcgatgaaggaaaatcaaaattcttgaaaaaaaaagttccatttttgtcatgctcttcattgagctgtgtctatcaacgaattgagatatgatagtggtttgagtagctttcgaatgtgttgaaaatgttgtaacaaagtgtgaatctattctcgattccagtggatatcttcgtgctagagaaatatgactccgaatatgtctcagttaaactactaaagacaaagtattattcgtttgctattaagatcaaatgtattttggagaaaaaggacctcgtataaggaccccgtatatattatttacctgttaatttttatcaaaaaagaaaaagagcaaattatgttaacacctttgagattttttcgaattacacacaatacctataactgcaatttattcaagaacattaatctttaaaagatgactttggtatcagttttccaaggaaagttgttcttataactgcaatttattctagaattaaatccttgttatttgattattcgaatttatctacagaaaaggaggcttgaaaaaatgattaattgatacttcaaatccaaaagatgcagcagaagttattgaaacttgctagcttgttatccttacttctaggtttttctagtttactttgtcagaaacacattttggcatttagctatggatccatcgccattagtttcatttagtaaaaataacactcattgttaatttaccccatgtttttctagtttgctttgtcagaagcacattagcctttatactcattgccattgtaggctacatggtattcggagattatttggagccatgaatcaacttagatctaccaaaaacaaaaataagtactaaaatagtgatatgataaatgaatttatccataaggttgaataactcgttgctgggacaacggaacaaaaaattgtagagaattcattcccgcactaatcatataatcatatttctttagctataaattgaatccttaagaatatccattcttgtaaaagtaaccattgtagtacagcttgttctttaatataaaaaattatcaatagaagcagcagtatgacaagtttgtttcaaactactctaactatcattgtagtaattactaattacttgccataatttttatctaattcaaaaggtgagaaattaagacattttattgttctgatctattcattattcatcatgtcagcaatctatctagaaaaattaaaaattgtcattaatctacctagaaaaattaaaaactgtcattaatttaggaaacaacaatgacccacaatgctgacatggcgaacaatgaatagatcagaacaacaaaaatgtcttgctccaggtttctcttcaaaagatacttgtattccagtttataacgtgtgttcccagatgactcagattgatgctaggagctctatccagtcccaaaaggttcagttttggaattggagctttctcctttcccagaggagctctctccatatttggtcctgcaaaggttgaaaatgacaggacgcgcttttgcattggatccttagaaatagaagatagtaaaaaatagaaagttgtggttaaataaaagtttccgtgtgtttggacttgtgccacacaactaataattacttatgcgttatctataaaattttagatgaatttttgcattaatgcgaagcttcggaggcagaaccaaactaacccttaaagtcaaaggtgctgccaacgaggtcatttacagttgctttgtatctggggacaatccagtgacgtcgtcttgaaaagtctctctcacaaaccttttcttttttcccttaaaaattataagagtatttttacatcaagcaaacatcacttttctcttctatttttttttctttatgaattcactttcatgatgttagttaagtgacatattaatttgtttaccatattagaacgaaatagtttctgtcaaaaaaatattaatatttattgaaaactgtgatataagaagtgaagtgatagcacctgtttttaagttaatatattatatagtacttaagatatatatatatatatatatatatatatatatatataaggaaagaaaatgtgaagaaaaagagataaaataattaaaaaagatgctataaaaaagaaaaataggatcaacacatcattctgctatatgattatcgatattatctataaaataattttagatgaatttaatctgtatatgattttgttaatcatgacatgataaaacagcaacctacctaccatgttctcagttaatgtctcctcagtcttcttcttgttctatgacactattgtgctactagtcttctctcaaaatcaaaactttcccctaatcatttgcttgccacactgcattccaccctactaagccccttgttcagatttatgacctcatcttctcagaaccattcgttttctaactgcagaaacttactggggttcccttgttccttctgaatttgttcttctacttgctttggttagcattgttacttcagttgctacgcgtatatgcttcattactcaactttaattcttgtgaattaagaggtaagaatgcatcattgtttgaataacatgcactaaaattactctcttgcctttaattttttgttgtacacttgcggcttgcccctttgctctcacttccattgtgttgctttccctcatataatcatttgtatttggttgatgcttggattaggagctattaggaaaggcatgcaggctatctggttcatgctattgttgttggtggctattgcattggggaattcagatattgattcactccttgaattcaagaagagtattcagaatgacccttctggattagtagttaattcttgggattccaggtctttagattccgatggttgtcctaagaactggcatgggatagtgtgtagtgaaggcagtgttatatcaatcactctggacaatgctggtttggttggtgagtttaatttgcttgcaattagtggccttacaatgcttcgcaatttgtccgctgtgaacaaccagttcacaggagatctcttgcatattgctacaattcaatcacttgaatatgttgatttgtccctcaacaagtttaatggcccgttactctctaacttcactcagttgcgcaagttaatatatctgaatctttcttcaaatgaacttggaggtactcttcctattgagtttcacaaacttgagcagttgaagtatttagatttgcacatgaataagttctctggggatattatgcatatattttatcagatgggcagtgtgctatctattgacttaagcagcaacaggttttctggtacaccggatttgggacttgcagatgagtcatttctctcttcaattcagtatttaaatattagccataattccttgagtggtgagttatttgctcatgatggtatgccataccttgacaatttagaggtctttgatgctagtaataatcagttagagggtaatataccttccttcacgtttgtggtatcccttcggattcttcgccttgcatgcaaccagttgactggtttactgcccgaagctctattgaaggaaagttcaatgatgttgtctgaactggatcttagtcaaaacaagcttgaaggtaccttctatgttttctgtgaaaattgtaatgatattctttcttcaaagttaaaacttatccattttctatataaatgtatctaaactcaaaaatgcaattgaaattgctagtctactccccatttgttgctgtccgttctgctaaccttcataaatgaagttttagctatgaaaaactactgccaaaaacccatatcaagctgctgtttggttgctgaaatatgaaactgcaactttctttctgatgccctgttctgctattttagttattttagataaaccctttggggaattttcttctgtggaataaataaatacttttcacaccctcaatcatttctagtaacaaagattgtagaggaaagtacaatatggtgaccaaactgaaatgaaagtctattagtgatcaatattggctgaaatacaaattatttcataaatttcttacctgtatacgaaatagtggagaactcaaattaaagaaaattttatatttgtccaatttgaagtttctgttccatggttcaacctattgatggataaattgtacttcaaacataattctgtatgccaaataagtactaaggaagcctgcattaattataaaataggttaaattagttttaaagtcctctaatttattatttaggttcaatttggtcctctaatttttaaaattgattcaatttggtcctctagtttttttttgttcaatttggtcttctactttttaaaaccaattcatttttttttggaaaatgtacattttgtggtggtctaaaaccacttagtggtggttttgaactgtcacaaagtgtgatttcttacaatttagactgaaggatcaaattgaattaatttaaaaaattagaggaccaaattgaacccagaaaaaattaaaagactaaattgaatctaaaaaataaattaggggactaaaaatctaatgttaccttataaaatacacagtatattaaaaacttaacgttagtattttggttgcatataatcagcatcagtccaatatattgatttatggagtcagtttgagatgcaaaatttgaaaatttgaaaagtagttgatgttaaaccctcttgaggggatcttttggatagtatacaaccaggtatgcaactattagcagacctttagatctttgcagaaaattcttatgtggtaacctatatctgcaataaagttggtgtccaggttataccatttttatgtattcatccgttaatccttatagaagccatttagttttctatgtacaaacattgtgggaactgggaagtaattccaaaatctgtccaaaagtatgctacatgtgacaaacaatctattctgcacgtagaaatcttggtatactttgttccctttgtctatacccaattgtttagcattgacttattcatcaattttagtcataatatcataaaatcacacatgacatgagttcaaagtgttattcaatgagtttctgcttacccttttcctcttttacaatttaaactttctttgtaggtcccattggaattattacctcggtgactctgcggaagcttaatttatcttcaaacaaattgtatggccccttacctctcagggtaggccactgttccatcatagatttgagtaacaacacactatcaggtaatttctcaaggatccggtattggggtaactatgtggaagttgttcagctaagcaccaacttattgggaggaatgctaccaaatgaaacttctcaatttttaaggttaactgcacttaaggtatccaataactcattggagggatttctcccaccaattttgggaacatatccagaactagaagagattgatcttagcctcaaccagctttctgggttcgtcctaccaagctttttcacctcaaccaaattgattaatcttaatctctccaacaataaattttctggatcaattcctattcagtttcaacctccaaataatccattagtttctgcggaaaattttagtctggtgtttcttgatctttcacacaacaacttgagtgggactcttccttcaaatatgagtaggcttcacaatttgtcatatctcaatctatgcaataaccaattggaaggtactattcctgatgaccttccagatgagttgagagtattgaatttgtcctttaataatctttctggtgttgtgccagaaagcttaaagcagtttcctgactcagcatttcatccaggaaatactatgctggtatttccacgttcacaatcatcaccaaaagatacttccaacctaggtttgagggaacatcagttacataaaaagtctgcaactaggattgccctgattgcatgtttggttgctggtggttttgtgatggcttttgtggctataataatttattataaggtccatcatgaaaaagaaaggacttctaaacaaaatgaagcaaggagcaccacccaacagagtactttcacctcaaatacagaggcaccttatagaaatttggaagcattaccacccgctcaaaggggttcttctgatgatgcaataaacattcatccagtgggaaagaagccaatagatcctggcccttttgaattaggtaagaacgaggaaggaacatctaccccaatgtctattttgtcaccttcaaatccttcatcttcaaaaagctataagtttgagaatcctggttccctcaaagtctcctctccagataaactggttggagacttgcatatatttgatggatccttggtgctaactgcggaagaactttcatgtgctccagcagaagttattggcaggagctgtcatggaacactctacaaagctacacttgactctggtcatgaattggctgtcaaatggttaagagaaggaataactaaaggaaaaaaggagttggcaagggaaataaagaaacttgggactatcaagcatccaaatctggtctctgttcaaggttactacttggggccaaaggaacatgagaaactgattatatcaaattatatgaatgcacaatctttggacttatatctccatggtaagattatggcctcatgcatgtttgattgcagcataacacctagacttttggttgtaaattgtaatacttctgttttatttagttgtttcaaatttttctgcagagacagataaaagaaatctccatcctttgtctgttgatgaaaggctcagggtggctgtagaggtggcgcgatgtctgcatttcttacacgatgagaaagccatacctcatggaaatctcaaatccacaaacattttgctagaaactcccaacagaaatgtcctcctcactgactacagcctgcacagaatactcactgctgctggtactgctgagcaagttctgaatgctggcgcactcggttatcgacctcctgagttttctagatcaagcaaaccatgcccttccctgacaagtgatgtctatgcatttggagtggtcttgttagagctcctaacaggaagaaattctggagaaatagtttctgggattccaggggtggttgacctcactgactgggtgaggttcttagccgaacaagaccgttcaaaccagtgctttgataggtctataatggacaagcacaatggggaaagacaatctaaaattcttgatgaaatgctaaaggtggctcttagatgcatccttccagcatctgataggcctgacatgaaaactgtctttggtgatctctcaacaataaggtagagttgctgatcatatcatatagccttaaccactaacatcatcatcatctatagttgttttttgtttaagtttcttttcaagtttgttgaattttggtcccttgatgacagctctccacaggcattataacaaattaacaagtcaggatatgaaatgaaattctttgtcaaaaggacattcattcttttcaacccttcaatgggcaggttgtatattcatgaattttgcagtattgttcagtgtaataattgatattgcttgacgttctttttgccatcgctgcaatcaatggaataatgctatgatccaaacccattgcatcttttattgcctatttctcttcctttcatgctttgaaattgatttaaacaggttggtacatgtacattgtaacaaccttggtaggtgattggtattggaaatttttagtttccagcaatctgaagtttagggacgttagtttatcatgcttgatatataattttaaaagaacctcaagatattgttttcgaggaatttttttgacgtatattgttataaaattgttcctatgggggttgggaatttaactttcttgaattaggaaaatttaatgatgtaaaaagattacagtatactcattccattcattataaatttgaattctcatctagaatgagtattttgaagagcaattcttcaatgagaggatttttcttagatgaaagtgtttttaagaattattatctctctgtctcgtatattatcccaatctcacatatattgaatatttaatttaattttaatatttattccttttaaatatacttaattttaattggccatctcaaattattatcgtcttatttttatatatatcttgatttttttaattgcttattttttcaatttatcattatcatctttattttaaaattgaacttataatatttttataataattttcaatatttaaaataattataccaaaatataaattatttatcataaatttaatatataatttacacatttaaaaaatatttatttattacaaatcttaattataatataatttataattaaaaaatatttattgattataattttaattatataaaaataaatatttatcttatacgtacattactcatactaaaatactacaaatataaatttttgaaaccagtgataattaaaaagtatttttttcgagatgtggaaattatcatcaaaataaataaagtctttcttccatgaatgtaattagaaaacaaatctctgccatgttatttaagagcctcagctatcaattatgtcttgttatttttagcattacttttaataaaggatagagttaaatacgttttccttctatgataaaattagaaatgtactttttcatctttgtaaaaaaatatttgttcgtaaaatataaatgtattattttatttgttcgtaaagtataaatgtattattattttttttgcccagagcatgaattattatattgaaatctatatgtataatctttttatatcagttatatgtaattatacataactgatgtaaaaatattatattttaaatcaatgatatatataaacaatgtaataaatatatatagattcagacataaccaaacctactttaagcaaaaaaataatatatttcaatttaaaaaaatgaaaaatagattaaaaattttgcaggacaaaaaatatatattattaattttatgaggataaaaatatattttatttatcatttttcctttgtgatattaaaagtaatcaaaacaaattataaactcgaactaaaaaagtaattaaacaacataaattttaatattttagtacttcttatgtttctatttataatatccaaacttaaaataatgcttgtttttttataagatttaatttataatatttcttgcatgaattattttagactacaaataccaaaaagaaggcaaaaatttaaaaaaaaatacaatttaattatttaattagcaaaagggggcagttgaaaaaatatttagcaaaatggggtggtcaaacacgcccagctggggcgtgtttaaacacgcccagatggggcgtgtttcaccagatggcgccacgtggcaggctgaaacagtgtcctagggttttcgcggtgttttcgtaaattacggaaggtcgtaacttttgactgggacgtccgattggcgcgaaaccggtggccacgcgctcgaaattgagaggagaaggcctgggcaagttcccgaagggtttatgttttagggtttcagattttggattttgggtatcgaatttagggtttgggatctagggtttagggtttagggtttcagatttaggttgatgggtttcagattaggttaggggtttacgttgtgattagggtttcagattttggattttgggtatcgaatttagggtttaggatctagggtttagggtttcagatttaggttgatggatttcagtttaggttaggggtttacgttgtgattagggtttcagattttggattttgggtatcgaatttagggtttgggatctagggtttagggtttagggtttcagatttaggttgatgggtttcagattaggttaggggtttatgttgtgattagggtttcagattttggattttgggtatcgaatttagggtttaggatctagggtttaaggtttagggtttcagatttaggttgatggatttcagtttaggttaggggtttacgttgtgattagggtttcagattttggattttgggtatcgaatttagggtttaggatctagggtttatggtttagggtttcagatttagggtttaggatctagggtttagggtttagggttgactatttagggtgtatggtgtagggtttagggtttatggtttagggtttagggttgactatttagggtgtatggtgtagggtttagggtttagggttgattatttagggtgtagggcttattgtttaggatttagagtttattaaatcctaaatcctaaacaataaaccctacaccctaaatcgtaaacccaaaaccccaccctcaaggaaagagctgagaaaacagaagcaaagtgaagagataaaatcaaagaaaattgcagttaaggaagtgcttgccaaggcaaaacttgaattggaaaactaattactcaatattagtgaagtgtatgtaacactcattaggttattcactggcataaaccctaaaccgagatccataacccctaagtgtgtaaccgaagaactaaaccccaatcacaacatcaaacctaaccctaaaccagaatctataaaccttaggtctgtaacccaagctctatacactaatcaaaacattagacctaaaccctagaccggaatccatacaccctaagtcccctaagtctgtaaccgatgacctaaaccctaatcacaacatcggacctaaaccctaaaccctaagtctgaaaccctaaaccctaaaccctagatcctaaaccctaaattcgatacccaaaatccaaaatctgaaaccctaatcataacataaacccctaacctaatctgaaacccatcaacctaaatctgataccctaaaccctaaaccctagatcccaaaccctaaattcgatacccaaaatccaaaatctgaaaccctaaaacataaacccttcgggaacttgcccaggccttctcctctcaatttcgagcgcgtggccatcggtttcgcgtcaatcggacgtcccagtcaaaagttacgaccttccgtaatttacgaaaacaccgcgaaaaccctaggacactgtttcagcctgccacgtggcgccatctggtgaaacacgccccatctgggcgtgtttaaacacgccccagctgggcgtgtttgaccaccccattttgctaaatattttttcaactgcccccttttgctaattaaataattaaattgtattttttttaaatttttgccccaaaaagaaagattgataatgtattgacaactattagaaagataaatataaattacaaggataattctaaaaagttatgaatttaagataaatttattgttaactaaactaattatttttcttaatcttcatgaattagttagataattgaatctaatgaaggaaataataaacttcataagtatttgcatacttttggtacaattgtttagccttttgaatttgcaatttctctcaagccatacataaacacatctgcttatctgaacacttccttatactaaaagcaggtagaactaactagctaattaatttatagaatcatggacaaaagtgatgacatagtcaggcctaacatttgaaagtgctggttttatcatcaaaaacatagctataagactgatcaagaacacttccccttgaacacgtactttcgaatactcactaggcttgcaactctaatggctaccaaaatcacttttgtgcaacaatactgtggcatgttgaaggccaagtacgcactcttgcaagcagtgacacttccatcaccacttttcacagccaaatctggtggaaatgctgcattcatatcagaagggcaactagtagtgttgcacaacccagaaccccttgttaagtcaatgagagaggcgaattaagcccatcaacgaggcttgtgtcatagaaaccttggccactagcatctgatgatggaaaattaataacaaatgttgctgatcaattatagcatgttcataacaaataataataatcatagaaaggttacagaacaacggagacgtctaactcggtttaactgagtgtgagttgttaaaccccagtaacagctgtctttgattgccacataaaaaaaaaaggttagagaacgtgtacctgaggttagtctgagttccatcagagatgctggtggaattgcacctgcaccattgcatggatttcaccagacccacaatctgcacccccacatgtgaatttccctgaagggtccttggagcagtgacttcttccttaaaatctaccagaccacccatctggggcatccaaggaaaatgaagacttggatggaagttcaaagcctgctgatgataactgtggttttcctgcagcagttaaggttccaggccacactgtgaatgcacaattgtttgtgaatgtgaatttgactgagtgtgcacctgtggctgtgatatgtaacatgtatgtgtatacaacaatttgtagttgaagaataaaacaagattttgttatctacttgtatatataattggcatataatagcaaatgataaagagaggggaaagagaatatgcgtgcatgcctgaggcatagatgcttaggagagtgagggccagtagagcttgagcttccatgatttttttttttccttctgcatgtggttgtgattctcccctctttgtgatgagaccagtggtggatgtggtgttatataggtgcaagaaggatttatatttggcaaattctaatggcccggtgtgcttgccaacactaagattaaccattcaatcacgacgcatgttattctcaatctcctaagtcctaatcctaagtttacacccccaagtttttatgttcttcacaaatattgttcattgtatactctatctaacgaaaatttgtttttaggttaaagtgtgttttttgtttctattaacatgaaatgttcaaaattcatccttgcaaaattttgagtatgtttttctttcttgcaaaatataaatgtgtgatattttgtttaagaactagatttatgatatcttattctacatgacaatgttaggttctcgtcaatgagtcaacacgtcaagttttagttgtcacatgacaagtttcacttgacatgttgatccattgataaaaatattgacacgtaggattagatctctcgagtatagttctaagccaaaatatcacatatttacattttgtgagaatgaaaaacattcaaatttcataagaacaaatttcaatcattttgataattatatggacgaaaaacattttaatcttatttttataatgtatgtggaacatatacaccacaaaacttgtttagtttgtgttatatatgtgaaataaatactcaacaaaaataaatttgtaatgtgttaaatttttacaaataaatattgtatattatagattgacacgccctatgtcaatctactgcacaatagaaacaaattttcttttgcccagttaattcaaaatacaagtttttttttttttgtaaaattaccatttttaatattgaactatttatcatacaaataacctttttaattgaaatcaaattagttacaataaaaaaaaaatattttaatacaatcaaattaattataataaaaattaactttttaattggagtttatttaatatacaagttatcatttttactagtaattgaattaattatgatgtaaattattattttttaattataatcaaattaattattatacaagtgataaaactttgtcggttgcacaaaaagcagaaaaacaaacaaatttcttgcaacaaacacttttagaagagcaagttgtatatttttcttgttaagtattgacccatgagaccatttcaagctaaaggaaaaaaaaaatatatcaggtaaaagccattaattggatatccattttataaacgaaaaaagattacattcataaagcgtactaatttggtgcaaagacaaatgcttatacaaaaaggaaagcattgaagggttgaggccaatccataagaaacaaaaccgcgtgtggcaaagcgccaactaactcgtagacaaaacgaatcggcaacaatcagcattaccgtgcgtttacatgaaaattggatacacgccaatccaaaattccaaatggtgcatccaaacactcctttgacccattcattttcgtttctttgctttcgtgtgtttttttctaaacttgcccaccgtgagtgatcccacattgaactgtactccattttccctcctttgtttattagttattatattaatgtctaggattttcataatcagtatttttagaatattaattaaaaaaatattgtagaaattataaaagagtataaaaaattataaacaacttaattttaattttgtctattttaataataaaaattctcctttttaatttctaaatcagtttcactatttaacatttgcctaatttatatttatatattaaattatcatatccttcttcaaataatcacttataagttataatcctttcttatggttttcatgcacttgttttgatagtttcgttgtctttaagttttatctcttctatctatgatcctaactaatttcatagtcacggctgaaagttctaattaattaattttgggagatttaaaaaatgttccatatgggtaagtgtgagtcatctataattaattactaacaatcaacaatgattccaacgtgcaatgcagcatttgttgatagggtgtgttctttttgactactaccatctaataaaaaaacattttgaagttaccaataaattttttttacttaatttaattttgaaaagtcccttaatattttttaaaattatactagcattataaattataaatttaatcttttagttaactttatttttaaatttttaattaatatctaaacaaataaaaataattacaagattattttcttaaaagaaaaaatcaaatttgacttagtaattgttttgaaataaattattattaatatatattcttttttattattattgtccaatagtaatttagattaaattttcatatatgacaaatgctaactgcctaaaatatattagtagaattcttaaaccgcgtgactattacattccaacgcgtaaaccgtttgcttcttatataaaatgaatagaataacgttgtgattcactcactcttctagcttcgaattttacaatttcatttcacttcaattttcagatagcttcttcacttgttactgactcgctcaatggctgaccgagttcaccccagccactcgccttccgtttccgccgattcacaaccggcatcgcctcaagactcctccgtcgttccgaaaccgccgtctccaccgtcatcggagaagccagtgcctccgcctggaacctacgtcatcaagatcccgaaggaccaagtctaccgcgtccctccgccggagaacggtcgccgcttcgaccaatacgctcgccgtaaacaccaccggagtcgatgctgctgctgcttctgctggctcatcggaatcctcttcattctcgtcgtgctcctcgccatcgccgccggcgtcatctacctcgttttccgtcccgaggcgccgaaatactccatcgaaaacatcgccgtcagaggaattaacctcacctcaccgtcctccgcggcagctatctcgccggagttcaacgtcaccgtcaaggccgataaccctaacgacaagatcgggatccattacttgaaggatagctccgccggcgtgttttataagaacgcgaggctgtgtaacggcgctctgccggcgtttttccagccgtcaaacaacgtgacggtgtttgggacggcgttaaggggtgacggaatcgacctgaggagcgaggaccgaagcgcgttgctggaggcgcagaccaaacggagagtgccgttgaccgttaggattagggcaccagtgaaaataaaagtggggtccgttaagacgtggaagattaccgttaaggtgaactgtgatgtgacggtgaatgagttaacggcgcaggccaagattgtttctaaacgttgtaattatagcgtggatctttggtgaaaaaaaccgctgagagaaaagggttttttttttttcttcgtttatagatagggccgaaacattcgagattatacaaattttcgtatacattaatgttacattgtagcacatttactgatacgcgtacgccatgtatcttaggatttgatttggttttgtgcataagtcatgtgatttttattgaataataaagtaagtaatttaatcgttcattcttgaatgtgaattcttgttgattggtttggtggtctctaaataagaaaccgcatcttggtcgtacccaccaaatgaaacaactactgtataaaaccttgtttcaagcaagatgatgttggaaatgtattttctaacacattttttaatttttatttaataaaatttgccaaaacatcaacaaattatgaataaaatttatcaaatagtgtattactaacaataaattctttatgctgtaaaaagacaataaactttttattattgactaaaatttattaaaaataatataattatgtgagtcttattcataattttgtaattctaataagttttaattaatactacatagtaaatattgtgctagtaagaatgtgttagataatatgttgttagtactattctattcaatataaacatcgcatattttgtttgtttttctttctaattttgtatgtgacagtttttttttcttaaccaattttcaaagtagagtaggtaacattaaaatgaaaatttctatgtaaaaaactgatttttttcataaaatagtattaaatttttttaacaacatattgctaatgtatcccaccataatttccggtgcatctttatccatcaaaattttcagcatttactgtttccatgctgtcattgtagcaggctgggaatagaagtcattgcaaagttctttccttccacaacggctacgcgtgtttataaaatttgggaatagaagtcattgtaacaggctgggaatagatgtcattgcaattttttttttttttgacataaaattgcatttttttatatttttttcttgtgttttttttttataatttacatattgaaaaacttttttttaattccttaactattatttttggaacactgattaacaatattctttcaagtattaggtgcaagaggctttggttcttctttatatatatatatatatatatatatatatatatatatatatatactagactataaattatactagttctataaattataatttaaatataataattttaatcttttaattaattttattttaaaatttatagttaatctctaaacaaataaatatacactagtttaataataaaaataaaaagattttttaaaaatcaaattggatttaataattgttttgaaaaaagatagtaatttttattctttcttttttaatacaatattaattagattagatttttatatataaaatattttaaccagtgtctaacacccttcatatactagtaatatccgtaaaccacgcgactattaaattttaacgcataaatcgtttgtttattttacaatcatattcagagaacagaataacgttttgactcactcactcacttttctctttcaagtttgcattttcattttatttatatgtataataaaaaatcatttttatattaaaacaccaactatttagtaaaaacaaaatcaactattaatttttcatcaatagctaaaatcatttactatacttttattggactacgatcctcctcctacctttattcaatttagaaaaactacatttaattgctaactactcttatttgttttacgaatcggtcaaaatctatgagtggggaaaagatctactctttggttaaggaataattccaagtattaggtgcaagaggccacggttcttcttttcatatatagctagactatttttttaatttaatttttatatatttataatatagagttatttttgttttagttttattaagatttgttttcttgttttggtattttataatttattttagttctcaaggttaacagacatgacaattgaatttgggtttggaattttctctcttttataaaagcggtgttggggacgtaattccagtcccaagcactatatataatttcatagtttaatttcttataattataaaaaaaaatataaattattattccgagctgtcatattagtaattagtaatatcatggaagctgcaaacattttgctaccgaaaattgttgtataaaaggcagtgatagaggctgttattcttttaatgattattttaatatttttgtgcctaaaagaagatttaaaggtcttgtaatcagccacggttaggggagtaaaatactatgaacactttttaagacattatcatcggtattgaacttgttttaatgatttcttttcatgttatcccttaacacaaaccctattttagtttttattttttaccttgaagccttttatctgatggctagcctggtctggtaataagtgggtacttccccaacccaaataataattagttacagttttttcttttaaaaaaaatcactactttaatttttcatgcatttgttttatttttaaaaaaaataatcagaagccaaacataatctaaaatatcattaaaatcagaagctattttaaatggctttcataaaatcaaatgcttctgccttttttttttaaatctctataaaaaaaatcactagattattttaaatcaaaatcacttgtttttaaaactataaaaattggtccaataatactaaaattagacattcagtcttcttaactaaaagagctctcagccatttgagtgttcctttataaaattcaaataatattattaatcaataattatatacacataacgtaaatgaaaaaatgacacaagcaaagaaaatcaagaagtacaagtactggtacaaactctttattagcaaaaaaattgcacccaaatttcttctccatcagaacctagtactttcagctcttactgagtccttaatcatgcactcataatctctctagtgcaatctatcagatcccttctattcttgggactaaatgaacaaataagtgtggcaatccgtaatgactttattacatcttgccatgtacaaatgctccatcctgtggacttgtatgctccacacaatgctatatttctgcaattccacaatgttccatagcaattctcttatcgtgtggatgtttgttttcagcctaaaacacttgagattgtaactctgatggatcaactttgagattcggaattcggatgaccatcttgagactgagaattcaaatgaccattttgagactgagaattcaaacgctggtaattttttacttcctgaatggcttgtcgaagttctgtgtacattttgacagaacaaccagacaaattatttaattgactaagaaatcgaatcaagcttcgtcgaaattgatcaagacctgtaacccagtcctctgatgtgtcatctctcaataaaccatctgctgattcgccaccaatatcaggcttccatgttgacatatgaggatgagcaccttttccttggttcttgtcttggtgtggtaagaactgggcggtatccgttgccaaactcttaatggaatcggcaacatcctttacaggtaaggcactaattttattcaaccagacagcacaggtgacatatattggaggatcataatagctaaggtcagattgatgcctcctttttctcttggatgatttttcttcatgacgaacacatttgtgaagccatccatttatagcctccagatagaatttctgagctccaatccacttggtaaagcttgatgatagaagttggagttcattttcaagataggaagtaatctgtctacgtaattctgaatgcatggtgattctagcatggctgttgttatatgcagccgacattatctgaaactgaagtttgtggcattcatgcatcatttcccacatccgattcaacctgacatcaaagtataacagaaacagatgaaatacaaaagctagaagatcatatcaattaacataagttgatgtgtgaaccatccgtccctctgactgaaaacatatgttgcttactaatccaagatcaaaaaactagcattcaaaggttgatcgcacaacatcagtgagtcacacaatagaaaaccatcaatcttgcataatcaattactaaaagttaactcttaacactataatttggaaaactgtcaattgcatttgacgataatgttactcctaatttagacaaaaggtttttgatacctagactcttctgttagaaaactctaggtttcagatgcagaaacaacacatttcagcaaggttggtatagaacaaaagcaaaacaataatttcagcagcaactgagcttttttattattgactattacttcgttgttcaataaatttataaccttcagtggaaaacttttaccaaataaagaacttaatcaattttagcaagttgtaccaaaaataaacttcctgataaactttcttattatggaatttcctgattgcacttcttgatgcaccttttatcccatgcttgtatatgtattattatcaaggcagtacacattggcatgaaatagatacttcataaaaatagcaaaactaacatgagcatacccttcaatcaactcctcaagttgtggttgaagctctttgtctcgtatctccgcaatcctctttgatatagagtttatcctatgaattgcaactctgattcttgagtgcagatccttgactttagcacgagttttatcaactgtagaggccttttctccttttgattccagttgccttaagaatttacgcttcatgtcatattcctttctgacaatctcactagcctactcgcagaattgaacgatgatattagcaaacagacagagaaatagccatattctattacatatttacatgtaccaatttattaaaaaaatataattaaacataaaacttcagggtttagtctaagatccaaatccaatacaagagttgtgcaacattttattatcaaaaagtaacatacagaaaatacaggttgacaaatatgttgataagaaatacatcgtaccttcacttcatcatagagtttcctttcccaagcatatagcctatccaaggttgatgcatgacttccggagatcatacaagaattatcaaagagattatttgcatggtcctcagcattgtcaattgagtttgctcctaaagggtttcgggatgaggaggattgagatgacaccgtcctatgccaagttaagtacttatccgagttttgagcaggttctaagaagatgaattgaatagttaacattgaattcaaaaaacagccgaaacacaggcatggatatctaaattaccaaaaaattagatgggaaatttactcagatggtctaatattaatcttatcttctgaaatgagtttcacttttaaaggcagactagagaatgcttattactatgttgcagtaactcaaaatgaattttaaactaagtaggaaacaaataacaccaaatacatcttctcaagtaaacaaattctccagattctctgcaccacagaatcccacacattcaacaatttcttgatcaacactaactgtagtcatatttaataataggatttgcaattcgcatcactcctacagtcctactgagggaaaatgtgtacacttagagaatactttcattttcagaactaacaagaagattggttcaaccccacaaggtcagaaatgtctgggaaaaatgaaagataaacagttgaaatgactcaaattaccttctggaacttgacttgggtcctcttggcttgggtcctccccacatgagaaacataccttcaaaaacgaggacaccagagaaccatctgttacaaataaaaattctctggttaaaattttaaagcattttattttgaaattaatttcacaacaatgaaaagaaatttccaaaagcttctttgaaacagaaagtgaatttttctttcaaaccccaaggatatcaacaaaatttaccataatgcaatttaatggatatccatgctgggagtgtctgtagcctatagggtatctatagaatgtatcttaagtagcagcgcgggggggggggggggggggggatattaactcaaaatctcatcattatattttacttgcactataaagttaagacctactaatatttaatattcccagatgataactgtttcaaagccagatgaaaagaaaagaagagagccagaaagattactttcttttccttggaatattggacgaaagtgaactttgtttgcttcaagcatctttggaacctcttggccagattctgaagctttaataaagagcaattcaatatctctcacgcttgaaaagaaattcttaggggtgactttattttcattacgactttccttctccgttggtttatttgtttcaggtggaggcaaagctggcataggtgctgtctttaatggagataaataagcaaatgtccccttttctccattcactaattcaacttcagaagctgaatgccctctgagaggcttagttgtggcaggttcaacattggcttgaacatgactgttagatctatttagattttcaaatctttggactagagtttctgtagcaggctcttcatcaaattcatcttcagagtccctagagtgttcccttccatgagatgaagccttctcttcttcgtcttccaactcaggaattccctcctcctcccttagtctttgtatgtcatcagcatgccctatatcttgatgcatacccttcccatcttgaaaagaaaattgatggtcaatggggtgaaagagaccaaagaaatcccactgtggagttccagctggaagagaagaatcttcaaatgctgctgttccagacattacactggtattctgtgtagtagtacctgatgatgttactattcctataacaggtacaggtggtttttcctcaactttcttggaagaaatagtgttatgtttcatatgatttgctctgaacttgctagaagaactaggaggggagggagttggagagaaattttcatgttcagctgcatctatgtgatgtgacaaagatgctgaagagaatgagagggtcctttcagttaaagcaagtggttgttctggtgttgcattagtgtacaaagaaggctcaattggtccttcaggttctgtaaattttctcagagctgttcctgtatttttcagtgattgaatgtatgaaacatgagcagctgctaatgagcaacgcccatcaagtgcttgcctcacaaacttcttcctttcgcgacatagctgcagtagtgccttatcatcctccattttggagcttgaggcccccattgttccaaatctggctcaaattggctttccctttatggaaatctttcactgaagttctaactgtaaattcatcaaacaccaaatgtattaaatgaacaataaatgaattaacataacaaacttagcaacaattgccacaagaaaaaatgcagatcactagtatcttttttaggtacacagaaacatgattgtatttgtaacacattaagaaaatggactgacatctaaagaactggtggaatgtcaccatcaactttcatctggaaacacaagcaaacaaaaattgcatctgatctgaggaatatgctgaggaaaacaatgttagtgaaaccactgcaaacagcaccaacaattgaagtgggaaaaccagctcaaactcgaaaacaatcaaagagaacaaaagcatccactatccaaaaagaacgttgaagttgaaatccaaaagacaatgttcaaaaacacattgagtgagtgcgtggagatgcagaaagcaatgaaatttaccacaaaggagacaaatttcaaggaagcgatagatagcccagctccaaaatagaaagtaggatatttattgagtaattagccaaaaaaaagaagtgggatcaaacccaaaaaacagtttatgtagcaggaacaaatggggaacccaaaaagcaaaaatcacagtgaaccgctaataaagaaaattggaatttggaaaaagatggaaaatttggcaggtactaaagctgcaaaatatgaatttggatttcagcgaagacccatgtaagagaatcattgacagaaatgggatttgggaatgttcagagaagagagagaaaataatgtaatggtttcactcatagctggttccatgcaaaagaagcacagcagtgaatcagtgatgcccacctccacgtgggtcccagtgtctgcgaaagttgagcgtgtgagaaatacgcgcttggaatattcaatataccaatgtacaagaaagcaaattgtactagctttcttttcaaaggcatctaattttccatctaaaaaagtgtctaaattcccacaggttcatttatttatttattcgtttaaaagattgaagaaaaaaaaaattgcgaagcttgaattaaaaatgaagttacacgtggattggttgaagttcaataatattctattatacatctctgttagtataaaagtatagttagtgtgagtgttagagtgtctaaactgatacaggtttatttatttattcgtttaaaagattgaacaaagacatagaaagctttaattagaattaaaaatgtgttagttgaaggttaataacctcaaaaaacttataaatgtgttcgatgaagtttaatattctcaatcaagtaagttatgcagagaaaaacttctctctcacacacacaaatataaggattaaagaatagaaatacaaaaataatattacaaatcaaaataacaaaagtcataaatttaatgtagtttgttacataaacaaatattcttgacctctctttaagttgaattactattctaaaaaaagaaagtgagtacattaaagtttaatattcaattttacatttttataattaaaaaacatctcaatgaattaaagtggaggatgattataaattatcaatagtattatttctaagtgagtaagactttttttaggacaactttctggcatcagtgtgtgaacctcatgtttactaaattgttaggcttaacgcatttgagtaattatttattttagctcatattaactaatctcattatttatccttaaaagagagggtgtttaaaaactattttcaccttcaattctcaaaaaatatgtgagactttttttatgtatcacatatctataaaaatctaaattatttgaaaagaattactcaagagtaattttaatatcttcatctttattttttcttaatctaactatcaaagatgagttacacgttaagatcattagacattctatcccaatcacttatatcttatagttgaattatttaagcatcgaagtccatgtgtgtgattaaattataatataaagatttcttacacttctggttcatatactattttacgtaccttgaaaaaagtgcatacgctattttcatatatataataaagctataaaaaaaattaaatgtgtaatttagaaaaaaaaaatactataattgaataatattaaaatgatatcatatatattaagttataagatattaaacatttgcaaaaaggtaagctgggcttagggtggtaaagtggaacatcatcacatgagaagaaaaacaaaagtgtagtgtaggaaatgtggacatgtgattagtttcttggcttgatgacctttttaggtcatgcctttataattgatgatttactttttctacatcgctaattctaaattcgtcttttaaatatggtgggccacagtaaatgtcaccatattcttcaagcatagtgtcagcatattcgttaccgataactaaaactataagtgataatgtgtaaaaaaaaaaaatatcaactttttttttttacatgaaaaaaattcatcaacccaacaatacatactttaaataataaaaaactactattatagttacattaatgctaaaacttttgtatgaaaattataattgactctcataataaatcataattatagtgagaaatgaattaattttagaaaataaataaatggataattataaataaaaaaaacaatgatgtgctcatcatcttttaccgttttcaagttatttttataaatatgtaaattaattaatttaacaactggataatgtgatattatcttaaaaatcttacaaattaaatttcagataatttaaacttctttaagtatgtaataaatagtaaaaaagagaattttaaatcaaattaattatttcatcagtgaataaaactaaagacagcaagaagaacaaaacaactatataacaaatgagatgcctagagcagcagcaagagaagaagaagctgattaactgagattgaggaagaagcagtgcattgattgacttctctatatataggtgtgcttgaaagttgaaagtaatgttccagtccttggctgccaaatcatgaatgcagcagataattagggcatgatgagggtgaaattcatgcaaatccatacaattgatcatacaagttagttgtacaacaacacaaatattatatataccacaaaaacctttaatccattggccgcaatgttattggagaatgaatctgttccgttcaagaaaaacggaggtccagttatggaaaactgggttttaatgtaggatcaatgctctctctctctgaaggtgtcttatgaagatcaaaacaactccaggaaattgatcacagcacaaaccacaaattggagatggggtgtgtgcactgtgagaatggaaaagagagagttagaatatgtgtgtgtgtcttgcacctttgatatgagggactatttatgctttcactgacctgtggataaatgaggaaactttgtcaattcttggtcatgatcttctaaaagatgaacatatattttggatatttgctggggaaataatctctaaaatcatccttgattttatatatatttaaggcttcaatctcttttattctgtccgtaaataaccctttcttgacagttttgggcctcttgatcttggcccaatatataaaatccgtaacagaatccaaaactggagttgtcatctgtgttgatcttcacaaaaccttcggagggagggtgtcattcaacgaagatactctggatggccaacactttgagaacactgacatggtggaaatattagtaaaaatttgtactcttagatactatttattaaaaattgtaatttttgtctctttaattaattttttattcacgaattttttccatctatttttttttcgggagtttagtctccttattaaagaaaatctctaattttgattcaattcacacacatatatatgtttgattcaatcagtgtaatatatattatgtgtgtgagagaggatgattcaatcataatgtgatataattaaaaattgttaaacttttaaaaattatatgcagaatggttttttttaattaatatatgtagaatgattttgaaagcataaaaaatctctacatgaatcaatttacaaattattatttatgtaattaataattacttaaattaaattaaatcatacctatagtaatactaaatcactctattattattattattattattatatatagaaaaaacataaatgtaactttttatttgtttttggtgttgctctcatttatgaattgtgtcacaatcaatgcaaactttgtttatttttaacataaacacacacacaaataatgaagtaataaatttaaaacaacaaagtatttgtatgtaaattatctaaattaacagacacacgcattcaaataaagagataaatacatttaaatattaaataaataattaaataatagtaatagtaataataataattagtagatcattactttttaaagtagaccactacttatttttatatattcattatatacatatattttttaaaatgtagatatatattataggtaaattattcactggcttaaatattaattaaatatttttgtctacaatatgctataaattacataatatttatggttttaattatttatagtaaaaaaattaagtttctatattatataattagtaaaagataataataaaaatggtcaaaataaatttaatattagctaatttgatttaataaaattattaatgttaattatatatcatatttagtaaatacataaattaataatattgaacaaaatatgtatatatatacacacacatatattggtatgtaattctataataattattaataatgtattgtaatgatcatagactcatataacaagtcacgcatttaaaaaatacattaaatttagtaaaattaatcagtacgtataattaatttaatattattattaaatctaattataaatcatctttaattaacgcaccatttaatatatttaattatagatgtattattattgtcattgtaatagtcttgaccaatattttagcgtctttttgtttcattatcaagcaaaacgtaacatgcattatatgatagaataaataagattcatttgtgcagaagttttaatctcatttaatggtggcaaaagttttacgttattatgaaactcgtttattggtgtacaaatattagagttcaactctattacaaacattaaaatcatacaatattttttcggtagaccatttatttacttatataaataaaaaatcaaatactttattacactaaattttaaagaagattttgccacataatcaaatacattattcacatgttgaaatgacacaaacggattaaaagagagattttacaaaagaccaatattaccccgtttcaaaaaaagattcaccgattaatattggatcccaaagcaagccttattatcatcttcagcaatttttctctaaaagaaatttattataaaaataaaaatattactaataggctaatataggtgccaaataataaattgtttattttcctttctattttttatttttttaatattttttattttaatatttcaattaatatatgaaataaaatgtcaacctaaatcaatttataaattattacttatgttattattaattaattgacttaaatcaaattaaatcagatctacaatatcattaaataattctattaattattactattattattagcaaaaacttaaaagttcatagataaattatgtcacatattaatatgaaatttatttatcattcgtaataatagttttaacttttaattatatttctcattagtaatatttttaataacttataaatataaaatctttaaatgaataatattgtgatcatgtgcatcaaaatcacagtaattttaatcttcaaaaaatatttcccctttttaaaactattttatatcaatttcatcattgagagaccaaatgaacgaatgaataataatttgatttaactcaaatgaaattcttaataaaatgattcgataaaaatatcagaacttaattataaagcttatacaaaataattaagtaagaattaaaaataaataaaaaatagattgttagtgctttatatacattttatcttaatatttatgaattttgatcaaattcaatttgaaatccttgtaccaaaaatgtaaaaatttgaaatcaaaattaatttgaacaatacaaaaactttaaatataactaattcacttaaatataacacacacacacacacaaatatatatatatatatatatatatatatacatatatatatatatatatataaagtcaactagatttgaaaaaatattaatgtaacatttatataaagaaagaattttttctttatatactatcataaatataatacaattttattatttaataatatttaaaaggaatataaacacatcaccatgcaattcttcatcaataaaatgatctaattattctttctcttttgcataccctcacacattcatgtatatgtaaaaccacaacgagaatgaaaaaaattcaaagacagtaaggtatgaagctataccgttaataatggtttaaaaaaattaattagtattacttatataaaaaaatacatatattttataacttatcactcaaaatctctacaatcaaacgtagttgacttaaaataattatgcaatatgtaacattctaaaaaaatttccgagaaacatattatataagattttaagtgatgaaaaattcttaccgacaagttgaataaaataccactatataaagtgttataatgtgaaagtcactgagatgctaacaattaggaatgttacataatacataaaagaaacaggacataatagctagctactcttttcaaaacaatttaaattaaaattaattactcatctcaatttatcatatcaacttttaaatttttaaaaacaccaaagtttttggaaaaaaaaaatcatcccaattaaatttctaaagaaaaggtcaagaaatagaataatttgttggtgattcatttttaatttttaatcaaagtatttttttataccaaaaacacattaatttcacattgaaaactcagtatacaaccactttaactagaccaagatgatcagttctcctaagcagcaacatttgtttttctttttcccttctgatacaaaataaaaacaataccgtgacaatgctcataagcatgtaattacaaaaacatttatatatctcacaaggaaataatcttcctatgtgaatgtgagtgctgtcctatcgaaactgcttcatgatcatgatcatgaaaaagtagggtcaagactccaactaaacacagcactgaaccaacaagaagcttgtcatatcgctccacccagtgaaacttcagctgactggccccataaaatgacaatgctactagcgaagtcatcacagttattgtgctgtaaatgcaatatgtgtaagcttggttagtaatgaatatctaaacaatttttatttgcaaacttaattggcatctaaaccagagtagcatcaacccagattaagaaactcggccttaaagattgtgaatcttttagtgcagaacagcattcaaaattcaaatacaagacagaaataaggattcctatatgttccatcaaccaacctgaatttcaaaaaagtagtcaagggatctagctgaattgttaaccatcttttttcagcttggatggcatctcaaaattcaagtagtttgtggtaccaaagagaggtttgtcagacatgatgtcttattagaagccttagcataagttgtcatgaaaaaaggtatacatgatgtcatgttaaaacaacttaatattccatgtatttccataccctgtaggaaaacgttcaagtgatagagtaattgttgacagaaaccagactaggcagtccaaccagtttaaccattaattggacacttgtccaattataattcagtctcaaaacataattgagggtcaaacacctttggaccaactaaaatactcaacctggtttaatctgtaatcacatttcctgaaaggttttataaatttgatattgtttcatgtgatttacaacttaaaactcatactacgtggccaactggtctaaccatgaattcgtcacttgtctgattataattcactctcaaaactgagtagatggtcaaacaacttcagaaaagttatggaatctccctattccctacctagtttcactctttggtcaacttttaacaacattgaatagaatttatttgattagtttctcaataatcaaaacaaattttaatgatcatgaagtataggatttcttgggagcttttgctttattcaatgttaaggtcaacatcagaatttttaatattgataatcactgacactttttccaacaaataacatatcactttaaataatcataggccattgtttaatacctgaatagtagtactatgatggcaagcaccatcatggaagaggaatttccaactgcaagaaagaccgggagtgttgtagcacaaggagacaatgcaggaacgagaataagtccagctacagccattttctccatgggttggttgtgtgaatgactatggccaccctttcccatcagaaacagaattatataactaccacccagaaatacaagcaaaagtgaagcaaccttatgcactgtttcttcaccagcaatggtgtttgccatggtaattgccgttataccaagcagtgaagtggatattacgtgcaaaattgctccaagtgcagctacatgaaataaaatgaataaggttaaaaaaacattatggacaaaatccaagaacacagtcttctgagtctttgcactagacatcatatgggaataagggcagatgcaatgggttggttacatatatgaaacagtggatagggctaagaaggaaattcagagtgctttcaatggcaacaaggacgtacaaagaaatttttgcaatcattggttgaagatgagagtgtcaacttcaacatccattgcatccaacaagtcattttctaaatcctaagttcttttatagctagccaagaatagctgatcatggagtgataaaagcactgagaagttaagttaaaatgaataaatcatattttaaaatgagctgtcaatatataagaaagctggattgaaagtagcaacaaggcaaaagactagaatggctcctaataagtgaaagttcatattttaaagacttaaatacatttttcgtccctgcaatttaacacttttttcattttcatccttacaaaaaaaaatgttttagttcttgtaaaatgtgtttgttttatttttcattcttaaaccagtttatatagcgctttgaacattaaaaaacatgttatataaatcactttaaggacgaaaaacataacaaacacattttgcaaggaataaaacaattttttttgtagtgacgaaaatgaaaaaaacgctaaattgcatgataaaaaatgaatttaaacctattttaaaagttaattacatgacaattcatgcaaatactaatgcaattaacttttgcactacagttgagtagcggaggacaacaaatcattgcaaaaacttgcaattattgagcttgacttgtagttagccagaatgtgagcataattggagtgcttttaagcatgtaagtcaaatatcaaatgatttaaatttgtagagtttcatttcatataacgattctgaacctaacgttttcaaaagtataatatagatttattcgagaagagaggttgcaagaggatatggaaaaattcataaccgcatcactagatttcatctttaaacagaactcaagtcattcatttgtgagaacatttattatcctttcactgctcactcacatccaaacagaagaaaagcacaatccctaaaccctgacaagattcgcgcatcacagagcaagaaacataacaaaagaagaaaaaaaccgttgctgacctaagttgcgcaattagagagagagagagagagagagagagaggaacgtaacgtactgacgatgagagtggtggagagagtccatttctgagcgcgaccgacaatggagaaaggaagccagtgagtgggaatgaaggaatggagaagcgacacggtggcgattccgccgatggtcgacagatcttcagcggtgaacccacccattgcccgcaaaatttggagaatctattgctcacaactcagatctactccacaactgcgaatcccctgtttctgtttcggattaggaccagaagcaccaaaatctgaataaagcggagaaaaagagtgggaaaagttatatatatatatatatatatatatatatatatatatatatatatgctattcagtaagtatttaatcataaataatgtgtttttctaaataaatcacaagtatttaatcataaataatgtgtttttctaaataaatcacaatttatatatatatatatatatatatatatatcacataattatttaattctaaattatttatcaggaatgacaaagaaatccgaactcggatatacttgtcctatctcatcccaactttgacgaaaaatactcgatttgactgaatatgaacatatggttcgagtattatttgggtgatttctttatgtacatgaatgaggatgggtaatcatatattcccgtatcgatcctcgacatctattgtggttattaaattacttttttattattacttagggttacacaatatacacttatacaataaaaaagtataaactctcaaactggtattcacactcattcactactcattagcgtcgctagctgccaaccctcgtctctctcatacagtcatctctcatgtcaacggtcatgtcgcgatctcgcatctttgaggtgtttgttgcgtcgctgtgttgttattccgatgaactctagtttgccatactcttcgttttacgtcgatcacacccttcatttcgcattgttggtgtcgattgtcgaaccacacattggtttcacaaacttgaaaggttgcatgcaaggtcgtgtcgcactcgcacgcactgtagtccttgaatactaacacaagaagtatgctttttgtttaacaatcacatgcacttcttgtgcaccatttataatatcttttttgaaattctcttagaaaaaactgttgcaaattgaaaaaacagaatcaatggactaaggatggggacagggcgggatacccgtccccatgggaacagagataggtgtaaaatattattcccaacggatcgatcgaaaataggaaaaggtatgatttatagaagcaaggacgagggcgggggacatcaaacttgttcccgtcccgctccattgtcatctctattatttatagtgaacttgttcgacaccaaaaatattattgttaatataagattatatcaaagaattaaattacataaacatttagtttgtttaaatttaagtaaaaaatacataataaaaataaattacataaaaatttaagtagaaaactgtttattttatgtaaaaccaatttaaacaaatacatcataaaaataaaaatcagcttattttattaaaaagtacttatattaaaaaataagcttaaacaaacttacttgaaagctcaagggtgtcttatttaagttccatttttatttatttttgttcttgaccatgctgaaacaattttatatcacttgatctacatgcttgataatatttatttttacttttaattataaaactgtcactttatatttaatctatcctattttcaaatatttgtacaggaaacaaacaaaaaagttattttcaatgtttgtttggaaatatataaaaaaaatgccggtaaacgcttaagagacatttctattatgatttttgatttattaacatgttgtacaactaaactcattattaaacaaaaaattaactcattatttatttatttttaatatctatttgacattgacttttatccttaatagaattgtatcattaaataaattgttaaaaaataaaataaaataattaattgtgtgaaattgaagtgacaagtttaatcatgaaagaagaggttgaattgtgatttttttttttttataaaaaattaccaacattaaactttaatgactttctaatcttttttttttcttatgctatggagttaatttggtgctctctaagttatcttcaaatgattattagattcgcaaaatgatgtatcttaacctcaaaagactcaaataatattactttgacaaacacataattatactgttttatatataagtaacaaaatggtaatgctttatattctaagaatggcgtatagtttcaaaattataatgattttatttgtcatatttggatcatttcgtccaaaaataagaaggaaataagaacaaaaataaaacacatctttatatttaaaaattaacttatatataaattaaaaaatcacttttgaataaattaatatgagaaaattcctacaaatgaatttatgcattagttacttttatgaaaatctttatttcaatttttctttcttttctcctgtaaataatactgataaaaaagtttatccggaaaggattactaaactaataagtgtaagagaaagaaagataagatgagtgctacaatagtacttcacacttatattatcatgtttggagttcaattgtcatctttatatagttattagttacatagtcaatgtgatattcataattgtaatgaaattcaaacatggattgtattaattttttaatttattaaataaaagatagtaatcacaaatagcaaattgcaatcaataaatgcactaatagctcatgaatgctcaacatttggttcaacttttaaatcatgtctatctgataagattatattttactactttcctcgttgaccatttgcatcctttttctcgaacttctatcaagcatgcaacaaaacaatgtatggtactaaacatgctcctcttcttcttttatttaaaattatcaataaataaatataacatcaaacgttcgattaggcatactcttctatttttctgatcagaaatctggaatgaaaaaaaacagcaaaaaacaaacaaacaaggagtttgtgactaacaaaatacttaatcacagcctccaaagcataataggaagatatataaaacaaaaaacaaatgttgagggcaccaaagcatatataataggtttttactagttaaaagccaaagcaaaatctttgcaatactgtctcgttagtttgcaacgtgatattgttctaacaaggaaccttcaaactttgtgtagcaagaatttggtttattcattcatctcgatcatatatgatcagagttaattaagattctggacacgtgattctgtgttgtcatgtacaaaacggacaaagcagaataaacaagagtgaagctaacattttctaaaaagtcaaaaatgtcaaattaatcaagaatgtatattttcgcaattttaaattgacgaccggccgcttcacaatttagtgtgtttagatgtgcattcatcaactttaattttaaatgattttaatcttataaaattaattttgtaaaaataattaaagtttgaaataaaataatttatgtttaaattttttcatctaaaaagtaatagaaatataattaatattttccgaatagtttaaagttcatataattaattaatgcctataattccgaaaagggaggagggtagtacctttgatattacgtactaaaattaggttaaacatggtttcatctaccgcaaaagcaattccaaggtgggtaggtgcaaattttggtttggacgactttggagagaaaaacatcatcaagtgatgatcataaacaaaaatttgtcatatatgatatgttaaaaccaaaaactagtcaataaaagctattgatgtttgttggattgagaaaacgtatatttcaaaaatgcattattaaaaccttctgattttttctctctaaatttagatggtaacaaacaaatagttgagggtgacctgcaaacatgataataccaaactaggtaggtagcttcacatgcatggaagagaaaatgtagctgtccttagttaatttgtctccatcaaaccattctatacccactcataagtcatttccttcaacatgcaccccattaatattaatattgtataattgtatataataataattcattacacatttatctttgacccaaatttgcacttatatttcataggtcagctcccaactctttgctgcacttaggcttctaacttggtgcattgactcaccatctttgctttgaatcgccatggaagataaactagcaacaacaagtgaaggacaacccataagatgtaaaggtgtgccatgccatgattcatgaaaaacaaaaaagtttatatgctcttttttattatttcaaatagatttttagctttttgaagttgatatttatgtttcatatgaataaatggtacttatttgttcttctttatttgcaaactgtagctgctatttgtcgcaagccaggttctccattgagtattgaggagatcatcgtggcaccaccaattcctcgtgaagctcggattcgtgttatatgcacttctctttgtcacagcgatgttactttttggaaaatggaggttattaccatcattttctttctctttgaatgatttaaaacatttttcttagtcaatgtcttcctttaccattttttatttactttcacactctttcttttgatctagatatctttctttttttagaagccttactggaacttcttaatgaattttttaagattttttttttttttttgtgtgtttaaaggtccctcctgcaatttgtccaagaatcttgggtcatgaggctgttgggtgagtgagtgcatgccctttcactctttttagttttataattttatttactggataatattattcattcctaaggaaaaagaatccactgtttattaataccctgtttgtactgtatctttctgtatcaacataaacttttgcgctttactttttaggtaggtagagtaaacttttgtggtttaatatataaatgtttggtcaaactttatgtggttcttactccctagtccttacagatgtggtttctacatacatcagttgtattaagttagggggcttgtctttttgggctctattgctatatcttttatacatgtaatggcttggttttgactagtttgtgctcaaacctttgctcttttattcaatacattttcctttcaaaagaaaaaaaggtattctgtgtaacaactgcttaaattgtttagaggcatctttgtggtctaactatcaggagtagttaattttctatattcaatcctagagaaaagattggatagttatgaggcaaattttaatgtttcaattttgatcaaggattaaataacaaagcaaagtgtgtctgcaaaccttcagatgatttaacaacagtaatcggaacattgatttaagaacaaattctacgactaattatatttatctttgctacctatttttgtgttggttgccaacaatttttagccaccttgagcccctttatatcttctgcatattatattatagaagctgatgatgatgttctagctaattttgatatgatccagggttgtggaaagcgtaggagaggatgtaaccgaagttacaaaaggagatgtggttgttccaattttcttacctgattgtggggagtgtatagattgcaaatcaagcaagagcaacctttgttcaaagtttcctttcgaggtgtctccttggatgcctagacacgccacctctagattcacggatttaaaaggagacatcatacaccatttcttgtttgtgtctagttttagtgagtataccgtggttgacattgctcatctaaccaagattgatccagcaataccacccaacagggcatgcctacttagttgtggtgtatcaaccggtaatttgcctaaaccatgcaaaattgtaaacattaaacaaaaagaatattgaagaactatatcagttgcataataagaattatagtcagaatatctgatcataaataaacacatgattgttttcacattttagttcactactcaacaacattcatctaattcagtattttgattaaactttcacttttaggggtaggtgctgcttggagaacagcaggtgttgagccagggtctacagtagccatttttgggttgggaagtattggattagcagtaaggaatccacatagcttttttttttttttgtgtgtgtgttttgtggtttattatactcaaacgctcattgcaagtgaatggtttcctaggttgccgagggagctagactttgtggagcaactaggattataggtgtggatgtcaacccagaaaaatatgaaactggtaatgcattatctgcttaatgataatgcttaaataaatttgttttgtatcattattgtgctcaaattatttaattgattttgtgggtttgttcctctgatttactcaggaaaaaagtttggactcactgactttgtccatgctggagaaagtgaaaacaaatctgtgagccaggtctaccctcttctaggctccaatatttatttaatttagttgccttaagtcttgaaatttccttctcatatgtgctttgtttagcaggttatcatagagatgactggtgggggagcagattattgctttgaatgtgttggaatggcatcattggtgcaagaagcatatgcttcttgtagaaaggtctatctcctttctctctctatccctctccctctatctatctatctatctatctatctatctatctatctatctatctctcaaagtgcccctaaacatgccttgcactatggttaataggcagacagagtaatgtgattgaatgaataactgcagaataattttaaaggatcaacctagcactagtaatagtttttcttttgtgctaactaatttgaaattcctggtacttgatgaaaatgaagtttgctgtcaaattgagacaggtttgattgtaaattttaataataaactcttatcagatgcaaacttgttgaatgttgttaaaactgatgctttccctacagggttggggaaaaacaatagttttaggagtggacaagccaggatccacgttgagccttagttgtaatgaggtcctccatagtgggaagagcctcgtggggtgcttatttggaggactcaaacccaagtctgacgtacctattctccttaaacgctacttggacaaggtactttgtgcaatttcttttaaattttttcagtctatgctcttgatcccttctgctaacgtagtgatgattatgtaaaataataatgccataaaaccaagttttcgggatgcttctttttagtaaatttcatctgtaattatcaacaggaactgaatttggatgagtttgtcacacatgaggtggagttcaaggatatcaacaaagcttttgatttattgattgaaggacagtgccttcggtgtgtgatttggatggacagatgagtccattcttgtaaaagtaattgttgctttgagcaactgaattatgacatcaacaagtaaaatgttggatgctgctcttattttgtatttgatgaaaacatattcaattcaatgtaaaagcagttgataccccaacaaagtaattgttaaaaaggttgattatcatcatcaatgcttaaaagtattatattatctgtttccctgaaacagcatcgtgtagcagttcccattttttttgtgacaaataatcatgcattgaatattatcaatttccatttgaaaaacaagcttaggccataagtgacaaatgacaatccaccacaatttcatcggtaacatgcttgttttatacatttatactatttttattttattcatccaaataatatatttttctatttatatctttattatttctttatcgtttaatttatattgttccctacctatgttccagctttatattttttctataaaaaaatttaaattttaatcatttacatacacatataagtttatttttgtggttaacatcgttactgaagtgattggcagtgttgcttattaagactactataaactttttctaaccatgcaaaacagcgacaaatttttcgcatcatagaaaataaaggaaatcacaatctacttaaacctatgtcattctcaatttcctctggcatatattgatacgcaaatagtttatttgaaataatgtcaatgattgcattagttgaatctggatcaaggtggtaataatacaatcatcatcctagagtatgaataacttatcaaaattattaaacaagccaataatgcaaaaaaataaaaaaatcagcctctttcggtgaatctgttacactatctatatatcaagacatttccgaagtaactgagaatataataagtttgaacacgtcgcaatttctcttatttttctgctgtgaaagaaattttaattttaacaattttgtactgtaagaagtatcttgtactggtgtattttcagtcacattactgatgatattaccagtagaaatcaaaagttaattcatatgaaatatgtaagtgctaaagcttatgattttttataaaagaaactgtaaagtgagattagagagagaaataccaataaaaccttgattttttttagagcattgaagatagagttggaatcatgtcacgccagaacttatagaagaacagtggataatagtttagataaaaaaaaaaaaaaaatgaaccacaaatcatgcacaatatatggcagttaatacctgtctctttctctagtttggaaattcaaagttcccatttaattttccagttatcacatcagtaatgcagaaacaggacctaattgtttatttttaaaaatttcaactttaaaatagaaatatataacattaattaatatataaaaattattaaaaaaattagaatcttgtataataatagtaatgtcacagtagaagattgattcctcaaaaactagataagaaaggataacacaaacatcgaactaaaacgaccttttttcagaaatttgtgggtgcatctaaaacttttacttcataatcaacaaacaactatttatttcttttttatcaactcatcaaaatgagactcataatctactatacatatataaaaactaactgctagcaaaattacaaaattggatatcctatgtttatgacacttggtaaaaaatggaggtaaaatggtaattgaacattaatttgctaattgcacccctttttaataagtgcacttgaattaaaacttgctaattgcatacccttttttataaatgcattccaatattttcaaattagaattcccaaattaaaacttgctaattgcacacccttttttataagtgcatcccaatattttcaaattagaacttgctaagtgcatcccctttttgataaaaaaaaaatctatatttctttcatccctctcacacgttatctctttaacacttagtcagtcgtactagccagttacaaaaatataaaatctcaatattattttaatttttcttttcggaaaaactctgaatcactgatgatatagtaattcctctcttatttacttaacaactgtctaaaaaagtgcagtaatttcctttcattttatgttatgattttcataatctcctactttgggtccttcatatttctcaatattgttggttctcatctcaattgacttagtctacttattaacatgtttgcacaggcgtaataagagatggagtcttaagtggattcattgtttaatgtttgatttcaacagaggtgtattatcacaagaagaataaattattattgaactccacttttttctttctcttattaatttacttgacaattgtctagagtgcggtggtcttctttcattttatgttatgatttttacaattttctcttgtggtcccttcatatttctcaatgttgttggttctcacctcaattggctgagtgtaattattggcaagtttgcacagagataaaaccttaagtggatcaattgcttttggcctcatttcaacagaggtatattatcacaagaagaaaaaattattattgaacttcacttctttttttctcttatttttgttgcacatccattttgtcattaataaaccatactagatcttgcaattttttaaatatcttttccgtctagatgatatgttgtcttaactacctttttaagagttaggtgtgtttaaatatcttccttatcatcttctctcttttctcaactctgaaacattcttcttctttgatgttctctattttctcaccatttttctctcttctcttaccttcttcattcattcaatttattttctctctcttctaaaaataaaccagtgaaatatctttttatttttccgttaaccattcaacatcgcaaccctcgttgaaaatgtctttgccatccactgtgactacaacttcttcataattttttcatgatttatagtgatctgtaagcaatgaacaattttcttagtttctattttcttggttgattttggtttgacctaattactttctttgatttttctccttcatcaaaatttctttaatattgtgaatatgaactaaatttgttaaaaatgtttatttgatatggcctatggattaaaatattttgtgaaaaaagatattaacaatagtgccttccaaatgaaaaactctccggattctaagtccggcgctatccgcaccacaactgctctggaaagtggatcttctctggatccttgcgctatctgcgcgggacctcgatctctgcagaaattgaaagttgctgagggcaaacttggagtttcacctccctaagtataaatactaaaacccacagctttgagaggactcttggatgaaatttcactagaacaaggctagagaaagcttgggagcttagctagggcttggagttgtgagtgcaaatgggattcttcccttcttctctaccttctccttgcttgtgtatcagctgggcatgcttctttttgatgtaccaaggccagccatgattaggtttggctagtttcatttgtagctagggccaaacacttgatttaaacttccattggaatgtattgaatgctattattcatttatcaaaagttattttactgcactttgcttgaatggtttctatctatttcttagacttgatcaatcaaatgaagggttaagagctagggttcacaataggaatattggggttctagtcttggaactaagtgtagtgacttgcttacattacctaggaataggagtttatgtttgtagcttattcaaagtgtttgcttaatgcttaaccctaaaaaggttgctaagggattatgacttttaagagggttaaagggttatttcactaagggattggagagtaactaatacgtgatgaaacacaatcgctaagtaacttagataattgaatgtagtaagcaatacgcatccattggaaggaatcatcgagtgtgggtgccttgactactcttcttccatattgtcattaatttagctttgttgtttataatcaatagttatgttttaattctagtctttacttttacttactcaaacaaccaactcattcttttaccaacatttatttgtccaacttatagatacgagtcacaatataattagtgcatcaatcctcgtgggaacgacaactcccttatcactttattacttgaacgaacggtatacttgccgatttcgcaacagaagcaaaaatgtcggtgtacttggtttgtacaatataattgtccctatttcataagtctccatctgacgtttctatattcactttctctaaactttagtcatatcactcatcaagttagttttcacttagcatatttaatatttcattgatcagctcccaaatcctctatacaattacactaacacgttgcattgcctcatgtgttttggatagccatggaacacaaagtagccacaacaactgaaggacaacccataagatgtaaaggtgtgtggtgtgccatcattcctgaaaacaaactaatgttgtctctgctctaccattttcttgtttgtagtaatttttaatggctttcttaattgtatgtcatgtttcatatgtgtgaactctatctgttctgtttcatttgtaaactgtagcggcggtttgtcgcaaacccagtgagccactgagtattgaggagatcattgtggcaccaccaatgcctggtgaagctcacattcgtattatatgctcctctctctgtcaaaccgatatcagttttcggaacatgcaggttgccacttgacaccatttttggtccctctaaatgatttattgtgatttggaacatttttctcagccaatgccttccctataccaccttttcatttcaattcaattgctgtagaatttagataactttttcttttggttctatggaaatttctgaaagatttttttaagatgcattttctatgttttgaaggaccatcctgccatttatccaagaattctgggtcatgaggcaatagggtgagtttatgcattttattttgcaccctcttttctcataaggattccactaccttgatggtatgctaaatgcgtatgcttttcctgtatcaatataaacttttcttcttttttcatttttttggtagagtaaactttggtgctttgatttttgtttacagaaaatttattgtagtctttactcctcagaaaaacagttcctatcataagttttggtgcctttttcgtttaatttcatgtgttttctgtgttacatatgcacttaagttgtgaagagccaactcaagagtagttaattttttaaatccagcttttagggagaagaatgaataactatggtcggtgagacaaatcgtagtgtttcaaatttcaatattgagcatggattttattaagagagaggcatatctgtaagcctgtttattattcaatgacagtaatttggccattgatttattaagagattctacaactcaatatgtttaccccttttgtcttcctgttggctgccaatgatttgccaccttaagccccattggatctacttgttcagacatttaatttgatactataggagctgttgatgaattccagggcttttttatgtgatccagggttgtggaaagcgtaggagaggatgtaactgaagttacaaaaggagatgtggttgttccaattttcttacctgattgtggggagtgcgtagattgcaaatcaagcaagagcaacctttgttcaaagtttcctttttgaggtgtctccctggatgcctagatatgccacttctagattcacagatttaaaaggagagattatacaccatttcttgtctgtttctagttttagcgagtacactgtggtcgacattgcccatctaatcaagattgatccggtaataccgcccaacagggcatgcctcatcggctgtggtatatcagcgggtaatttgcctaaaccatgcaaacattaatatagagaagaactatttgttacataatactacctctggtccttatattataagaaacaagtgatagtgtaaattcttataataaggaccggaggtagtataaattttggttataataaatacaaggggttgtttttacattttaaatcactactcaacaacattcatgaattcaatatattgattaaacttccacttttaggaataggtgctgcttggagagcagcaggtgtggagccaggggctacagtagctatttttgggctcgggagtattggattagcagtatggtgtccgtttagctctgttttctttcggtattttgtgattaactatattgaaatgcacattgcaagccattggtatcataggttgctgagggagctagactttgtggagcaactaagattataggagtggatgtcaacccagaaagatatgaaatcggtaatgctttttttgtttaataatatcacatcaagcatttccttaagcagtaatgtttaaataaattcttgtctatgttattattgtgctcagattatgtgattggtttttttggtttgttcctcggcttttattcaggaaagaattttggactcacagactttgtccattctggagaatgtgaaaataaatctgtgagccaggtctaccatcttctaggctccaatcttaatttaatttaattaattgcctcgagtccttagatttcttctcatatggggttgtgattcaggttatcttagagatgactggtgggggagcagattattgctttgaatgtgttggtatggcatcattgatgcaggaagcatatgcttcttgtagaaaggtctctctctccctcaacgtgtgcacaaacatgccttgcactatggtttataggcagacagaataatgcgattatattgtaaaacaataactacaacatgattttctactatcaccctagcacaaagcttgaaaatccactaaaagtattactagttttcttttgtgctaactaatttcaacttcctagtacttcatgaaatgaagtttcccttcaaatttgaggtaggcttgattgtaatttcttaactgatgcatacttgttgaatgcatgaattgttaaaactaatgctttgcctacagggtcggggaaaaacaatagttttgggagtggacaagccaggatccaagttgaaccttagctgtagtgaggtcctcgttaggggattaactttctacaccattcatttttccaatacacccaacatgcacagtgtaataccaattttacccttctcataatccgtaagttgcataccaacatacaccattcgatttcatacggatcggcaatccgtaagagtcatacggatcgacaatccgtaagagtcatatggattggcaatccatatgactcttgcggattgccgatccgtatgagtcatatggattggcaatccatatgcctcttacggattgccgatccgtaagagtcatatggattggcaatccatatgcctcatacggattgccgatccgtatgagtcatatggattgccaatccatatgactcttacggattgccaatccgtacgagtgtttccagctacagtaataacgccagaacttacctccgacgacgattccggccaatgaaacctccacgactgctaacaacgacctctacaccaaaccaacaagccaacaaccacgaagaatccaagctagaaccaagaacaggagtgagaaggaagatgacgcattcagctggtgtatgcgaaaaaaaacaaagcaaaacagacaagggcaatattggcattttgacaaaagtgttgggtgtatgggaaatttgcctggtgtgagaagttaaaccccctcgttagtgggaagagcctcagtggatgcttatttggaggactcaagcccaagtctcatgtacccattctccttaaacgctacatggacaaggtactatgtgcaatttcttttacttaatcttttttagtctatgctctttgtcccatctattaatatgtgtaaaactagtaattagtaatgattatgtaaaaataacaatgacataacataatagcaataacaagttctggggatgcttctttttatcaacaggaactgaatttggacgagtttgtcacacatgagatggagttcaaggatatcaataaagcttttgatttattgattgatggacagtgtcttcgatgtgtgatttggatggacaaatgatctcattcttgtataagttattgtttcgttacttaagcccttgaattatgacataataagtgaaatattggatgttctttttttgtatttggagaaaacatattcaatgtaaaagcagttgatgcccagcaaagtaattatgtcaaataaattgatggtcaccaacaatgcttcaaagtattttactagtatctattttctgtgatgactaatttccattgtaaaagcaagcttaagctataattacaatgatcatgaatgacatgtattccattccacttgacgcggatgcttaatcgaatgtgtctccgttatatggtgaaatcacataatactacattacatgtattcgatcggcaccggagtgtggtggattctacatacgcctaaaggttataaacctaaaatatttacattgtgacacattttgtttggtaattcagggaactcccaaatattatttgggtgccttgtaagcagaaggtctgacttatttatttcccttcttcctgaataataatgaatattgcaagaaaaaaagcacaaaatattagttttatcttggttcactttatgaaattaaccagtacagaaagttcaaggcattttgttttcaactatgcttcaacattcttcatattggcttcctgcaaataacagctagaaaataacttagtgggatttccgaagtcatagtatcaaactctccatgcgtggtgtttccaacactttagatctcaccaagctcccaatggtattgacgaaaagcttagcatcatccaacactctcccacgtgccaacttcttatacaaatagttctcaaacatcatgcgttgaacatactcatccccacacagttccaccagagccttcctggacacgttactacgtagaaaaccctctgcagcatgtgcgggggagcggaggaaggagtcgaagacctcgcagcggagcatggcgatgaacttgtggggttttagggttttgcagaagtcaacgatgatgttggaaggggagaagatgcgcatgaacgtcacgtggcggtcgatgaggtggtgaggaatgtcaaactcttctagcatgcagagagggatggcgcgccgcacggcttcacaacggatgctgggttgcgttcgaagaggaaggtctcaacgccgtcggaggctagggcctctgttgcggagaatccagcgaggccaccatcaatcactgtcgcccggagctttcggccagagatggatttggagcctgagacggtgaacgagtttacgtaggcttttgaggttggaatggagaatgtagataaacaaaaattagcttgaattttcgcagccatggagagagttaggattttggatcaatatctgtgaattaaggttttctagtttgttccttccatgtgttttagtaataatatattaataattacattttctttagcaaagttgtatattggttatttttttcaagttcttatttaatattgtaaatgcatagtttaatgtcgatatcaaaaccattttgtgctgtgtgattctaataaagaaatgatttccaaagcatacccaacagtgttgcagtgcggtagcgccctatttctttaacttttttttttactgctaccccaaaatgttctgaaacttttgtttatgaaacgtgtatatttgagagttttaggtagtgtaaatttgacatcaccaaggttagggtgtttatggaatggattttcaaaaaataattcaaatccaattaaatgaatcggatttaaaatttatattatccacttaagtgcataaaagtagtttggatttttttaaaatcaatttaaaatggttttgaaattagtttatatttcaaaactatttttgttttaaatctaattttaaatcataaatcaattttcaacctacttcgattagggttgcttttagctggccttgatcgcaactattttttgttaattttctgttaggattatttttggccaacattaatattctattttagatcaatgtggaactattttttgttaaggttgtcaatgtcagtcgataattttttttgacgaaattaggtagggttatttttttgttgacatagattaggattttttcaatcaacatcggttgtgactatttttcagttgactttggctagggtctttttcactctataacaatcagacttttttttgttgactttggttagatttttcaatcgacattagtcaatgatatttttttgccctacattgatcgatcttgatttttgtcaatatcagtcaagactattttcgattgacgtcaactaggatattttctagtcaatgtcaatcgataatattttttagtcacatcaactaaagctattttggagggacatcgatcaaggctatctttttgccaatatcggcttgagtcattgacgtatcaatccaagttgatcaaaaatcttaatcgatgtcaaccaaaaaactcctaaccaatattgcttaaaatagtctcagtcgaaagactaacatattgttgaattcgtgttttattttatatctactgccgtattagtatggcttctagtaaacaataaaacaaatctagcttgtttggaaaatctaatacacactgattttgttgtatgttcaattgcgaaaatctaagttcttcaagaaaactgtccaagtttgttcctaataaaaatgtccaagtttgttcctaataaaaatctgattttgtgatgatttaaggttggacgcgtgaattgtcctcaatgcctttgcaggattcgactaattagacaatttatggcaaataaattgaacttaaaacaaaattgattgatctctaaatttacttatttgcacaacaacttgaaatagatcacttgataatattgagatgaaatttcattacacaaacaaataagataaaaattacaaaaacaaaatacatatatactgataaacacatataatacagaaccatatgaaactaatgcattccttgtcaattagcatgggttctgttatttgttcttttcaacttcattaattaagcacaccctcaacaagtctcgcgagccattgtggtttcccagtcatgaaaacattatatcccaaaagcattccaaatagcaacccacatgcatatcccgctgctacagcttaatctcttttttcaatctcttcaattttctttatgttagcttaatctcttttgttgaggttgactagatttttatagatcatgttaatctaaattagaggtgattaataaaattttgtttgaagtgtgaagtatttccaatctttcaaatgtttgaggacaatcatttttgtttaactttggggtatgagttggccaatctaacctacttatttcattgttatcattaattttgtatactcatgtatgatactaaagagggaaaaatagttgaaaaaatacatatttgtagtatatataaataaaaattataaattttctcattattaataataaataatcaattttatcaaataatatattaaagagataaataaattacttgaatcaagacacgtcatgtttatttaaaatagtatatgtcaaatttcaaaatttaactgagatgaacaaatattacaataatttttaaatatattttataaaaaaatctttgttttatatagtttatgatttaaaatcaaaattttaattagattgaattagttttaagtagttgtatttaaaagggatgaaaatataaaaatatttgggctaaattgtaattttggtatccttatttctaaatcatgacatttagtttatctattctttgtatatgcaagggtgatgctgcttacaattttcttccccattacctactctagtgtgaagcctccgaacataatgcacagtaataagaaaaattattaaaatatatagttaattcatttagttaattttgtaaacattattttgtatgtatcattcataaaaagttattaattattttttgaattatacaaatttataaattttaaaaatatttaatatataaattttttattgttatggttattatttatttatatattttcagttaagaaatctcccaatggaacacattggcctgggcgcatctacaatcatcatgcagcaaattaaattaatcaaaatttctttgtcattattttagttctccaatgattttatgactaaattaattctatgccgatatcttttttttttttttccaaggcagtattaggataaaccattatgtcaatttccgtatcttaatttttctggtaaaagaaggtttcatctcaaaccattatgttgttgaattcctgcttcattttatatccactacggtaattagtatggcttctagtaaacaatacaacacaaatccagcttgcttggaaaatctaaaatacactgattctcttgtactttcaattgttaaattgtaaatcctttaagaaaactgtatgagtttgttcctaataaatgctgatttttttgtggattgaaggttaaacgcgtgaattttcctcaatgcctttgcaggatacaagtcagacaacttacggcaaataaatacataatgataaacctacataatacagaaccatattaaactaattcattccttgacaattttctgacatatagcataccttcaacaagtctcgcaatccattagggttttccagtgaataatacattacagcccaagaacattccaactagcaacccacaagagtatgaagcagagagctaagatgcagccaaaagaaaaggaagactttggaatgatgctagaaagtaaccttaaggagctaattaccttgtattaaaaattaaattatttttattcttatgttactttcattttcatttttctttttttcttttctcagtagctttgatgcctgaacaacattcatcatgaactaattacatctgaaaatacaatgatacaattgtacatttaattctgttagcctaattcttccagaaaaacagtacatatgttcctaatataatgccaattgtgtgtcgattgaaggttcaatgtgcaaattttccttgatgcttatgcaggttaccctagataatttacggaaaattagttacttgaaattaaaacaaaagcattcatcacattttttttcttcttatttgcaaacaacttcaaatagatcactcaggagaggtgagatttcttccacaaaagacaaaagttaaaattacagaaaacaagacgcatcgcacgaaagaatcatattaaatttatttttatatcattaaaatccatcataaataaataattttaaaattcagctaataaaaagtgtttcagcatatttttaatatataaattatattttaaatttataatgaataatttaaattatgatataatattatttttaaatattgataatttatttttataagaactattgaaattcaaatttaaaatagtgataaaagatggtagatgaaaagagacaaactattaagatgtttaaacatacaaatacagataaaaaaaaatgacagtttgagatgttttaatttaccgtattaatgtgtgaaattcacatccagtttgagacgtttcacgtgaacaattttttttaaggaaaaaattacgtttaacaaatggatttaagatgccaaaatggagtctgtaaaactctttggcagttgtgaaatgctagaaagtccttttgacaaatctttaatcattgagtgaattttacgtaaatcccatcactcaaattttgtaatagaattcacatcaaatttagtcaataataaaaaaaatgttaaataagattatattgttagtattgctttttaaaaacaattgaggtacattatctgattctaatgttacctcaacccttaatttcaagaacatgcttacccgctggtgcctttgtctagaaattttttaatgcatatggatcagtctttccagaggctgcatcaggatcaattatcaacttcaatatctgtttgtagaacagagagttgaaagaaggttttaactcaagcgacaatccatttgtatgcaaattctccgtcttttactattaaatactttgtttcaaggatagcctttgttttggcaaataagaaatcctactctttctggttggagttttggcataaagtcctttcactaagcaaaaacataccgatcttaaactaatggacttttctgtagtgctgttagtaaagaaaaagacagaagacccacagaaccttcatccgcagtaaattctaaaactaccgaaaggttggttttctacttcttttctcagtagctttgatgctgaacagcattcatcatgaaccaactatatctgaaaatacaacgatacaattgtacatttaattgtgttagccaaaattcttccagagaactgtatatatatgttccgaatataatgtcaatttacggaaaattaattgcttgaaattgaaaccaaagcattcatcacaattttttttcttatttggaaacaacttgaaatagatcactcaccagagacgatatttcttccacagacagaagttaaaattacagaaaacatacagacacacacaaaagaaccatattaaattaagagtaaactatttccttcccctatgatttgtcctttacactgttaattaattaagcacaccttcaacaagtctcgcgagccattgtggtttcccagtcattaaaacattatatcccaaaagcattccaaatagaaacccacatgcatatcccactgctactgctttccagccaaatcctgattcttcatggtgaaatgttgaatgtggcggcctttcttcatcctcattgcaggattttgacaaaggggatccacatagcattggatttccaacataggaatcattttcaaatgtgttaaattgtccacctgtaggtatgattccctcgaggtggttttgtgaaaggttcaacacagccagaaaattcaaattggtaaaagccacaggaatctctcctgttaactggttccatgaaaggtccaaccattccaaatttcttaaattaccaaaggatcgtggaatggtaccagtgattgcattgtgcgaaaggttaagccctatgagagaatgcaattctccaatgactttcggaagttctccttcaaatatattatttgataaatcaatggttgtgaaaatagttaatatcctcttgagctccacgaattgacctttcattacaaccactactgaatcattatagaaattggcgttacccatatatgtcaaaccagtttggttgtcattcacactcaccattccttgaaagttcttgatgtatgatgctggcaagggcccactaaaattgttatttgagacatcaaaaattctcaaactgggaaatgaatgcttggcaccgaaacaagtgatgacaccatgaaacttatttgatcgcaaactgagtacctgtaactgctggaggctttctagccaatggggaaatgtatcctctatgttattgtctgtcaggtccaaaacttccagctttgtgcagtgggccaaagaccgtggtaatggtccatccaattggttgccattcaactttatagtctccaattcatttccgtaataagaaaagttcccaggtatgttgccgtaaagtttgttgttttgcaaatccaatgcgaaaagagaaggcaatgttcccaggcatggcggaatctggcctgtcaagttgttatgagccaagttgagtatctggaggtatcttgcatcgcacattgctgaaggaatgttcccagtcagctcattatttgagactaaaaagctctgaatggcattgggtggaattgggagatctccttgcaacttgttgaaactgaggtcaatatacatcatgttattccaggagtgcaagagcttctcatgaaaccacgggggaatgcttccacgaatgttgttatgagaaagatctagtgcgagcagattttgaagtggtgctaagaatttagggaaactattaatattacaggaagataaatataagtgatcaaggtggggtaagatgtagtcagcggtactatcaacaataatagagagaaaactattgtcagaaagatcgaggtgatttagatttttgaactttgaatcagcggtactatgaaagtgaatagagagaaaactattgtgagaaaaatcgaggtgctctagatttttgaacattgaaaattgattaaagtgcagatgaccactcaagtcaattgaccctgtgaggtggttgttgctaacatccaaccatgccaaggaaggcaaagaataacaccaatatggaatggggccaactaatttattaaatgatagatctaaaaagaagagttgagttagattaaagacggatgagggaagcagtccatcaaaattgcaaccccccagagatagtgtgtcaagagacttcaaatggccaatggaaccggggatgttgcccgagaaagcagtatgagagagatacaagtaacttagtggagtactccagtttgactttggaagttcacctccgaggtctttattatcactcaaatatagtcgttgaagattgggtaaacagaggatgtcactggacagattcccttgcaatttggtgtcttcgagaccaaggaggatcaaagaggaagagagattggttagcaatgacaaagagctctctccgatacaagacatgtccacgccatctaaattaagctctcttaaattagttgcgttttgaatgagcttcttccatgtgtatggatcaattcttattctcgggtggttgggatcatcatttatattgtagagatcaagtgacagtaatttggacaagtgagagattgtggagggaatgtcaccaaaaaaatgattataggataggtcaagaccaatcacgtggcctgagatgatgtcgcactcgaccccaagccactcacaacaatctgttccgttgttcccaaaataataatttggaatgttgagtgagtatttgagttgtagcaaggcagagctgtcatcatggttgcagaaagaggaagaagaaggaagaaaaagaagaagaagaagaagaagaaggaagagaaagtaagggagtagaagccaccaaacattcttattcatattcatcctttcaactcaacaacaaaactagagagtattttggatgcaaccatttcaattcacgaacttctatttatagcctacgctgcttcaaagcctttcatttcgatttaactctttctttgctttttcttccttcgcctgtgatataataatatatttgtaaatcattatcaaattaattttatgttattcagataattttttatattgccaaccattaaaaagtttaaatatttataattttgctactaattgattcttgtaacaatgttaaagttaattatagtttcctctaaatgttatattttttactttatttatagtgtttttggttaaggaaaatgttaagcaaatcactctacagtgggtgatccccatcaaacacacatgacatggattaaaaaaatattattttattattaaacaattttaacgaaataaaaagtaaaaattagaagaaattttttaaatcaaataaaaaagaatgaaattagggaaaaggaataagaagatccaattattgtggctcctgcacaaaatcacctcttctccttcacaccctaatgaaggtgattttgttactttcatcaaaggtgattgatatgtggtcatcattgtagttgtatttgtccctttgttattgcattaatgaaacccaaaatttattcttcaatcatttttgctttgaacattggagggacaacttcctcatcatgaaggttgtttaacgagaatgagtgcatcagtggaggttgttggtgtgaagcagtcattatcgctgcattcgtattcatgtgactattggtgaaatcaaatcctttttctttaaaatatgataattttatttagtctttaagagaatatgtttattccatggattcacaatttcataattttcttcataatcttgggatttgaatcatttactcaaaaataaccatatctaaaaacactatagaagaattcgaattataatacaaaaacatattaattacaccaagagttgttgtaaattgattattaaacataactataacaaataattaaaaggttactaaaattgtctacttcttctttttttttttttacttttacaaagagaaatatttaaatttattgcttcaaaattttatttgatatcacactagttttctttttcaaaaaatctgttaaaaattatctcttaagatttcttcgtcaccatcttagttctagtctatcgtccgtaaaaaacaaaaaaagtttagtctaatatcaagttaattcctcaattttttatgtaactacttttttcatttattttgttatttttctagttcgtattttttaatgacaagtaacatgtttgataattctttaatagaaacttgtaaaatgattatattttatttttgtactttgggtcacaattatattgaacggggcacaaaaaaaaaagagtaaccatttttgaatattttatttttgtaaacacaaaattaaccctcattatttttgtctctattttttttgtattacatctttcttagtagatgtcatgtgttaactaacgttttgattgagtgtccaaaaattatttttgaataagagaaaatattagcttaatcaaaactaataaagaagaatttgttgttttgagatttaatttgttgttttgagatataaggtacttttaaactctctctcaatgatatccaagcataaactaagaagttattattattattattattatagaatttttatggcacctctataaagttaaggaattttggtagtaaaacaagatattatgttagactttttattatttatttatttgtttattatatctctatatagtcctgtcatttgaaacggaactagctaagaagaaagttaaaatgcaatgagcactcaatatcacatcaaagacgaagacgcaatagtgataaagtaaacagcgtgtcaatgcattattagttacttttaatttttgtttcagatatacaagatgcttcatacaactttaattctaaagttgcaagaacgttaaatcatgaataatgataaccatcgacagtttaaaccgcgtaaattgtggttcgtgtatattttaagaaatatttaaatatatttttgcataaatatatgtttccaaaaatattattatctggagcattattttatataatatttttatttactacgatgatgtcttacatatttttcttttgatcttttttttttaaacaaattgacttaattatttttatgatttgcactcttgattttggataacaaaaaattgagtgaaaatttttaattacaatagaattcttttgtatttaatttatcgtgttaagtttcaaacatcattaaaaatgttttaacagtaaaaaatgtaattaaaaaatgtcatttaattttcattgtgattgaaatggaaggaaaaaataaattatattaatgttaattatttgaattgatacttcacaatttgattaattttaaattaaattattttaaaatttaatttcatatatatttgcattatgatatctttcctttgaaattgaattatttccaaaactatattaaatcattttccacataaattttgtttttagttttacaatgattaattctattttaaattaaattagtttaaaaaataatttgttcattaaatatttcatgaataaatattataagaaatgaaactttattaaaatgaataaatattctttgtgattaaaattcaatcaaatattcatggagaaatattttttcatcaatcatacaatcctgtataattttcatttgcaaagtctaaattttcgtatgataaaaaatattattaaataattttatataattattttataacaattcttaaatattttcgtgaataaatttcataagaaatgagactttattaaaataaataattttttttcatgattaaatttcaaccaaatattcatggatcggagggatatattttcatcaataataaattcctgattaaatttcatttgcaactaaattttagtatagtaaaaaatgttattaaataattttttataattattttataacagtcgttaccacggataccataatttgacgtattattatggaactaaaatatacataaaataaaaattaaattcatataatagttaatgtaaaaaattaattgcaaaatatttttttattaattcgcctgaaagaaatatattataataaaggtaactataactattattaatgaataaataaaaaaatgatattgattacatttatcattaaatttattattttggaagaaataaatacagaagcgtcacgtgatatccttccatattatacagtatattgtattagtttttttttaaaaaaaaaaaagttgtcaaatcaatctcttaaaaaatttcttattcacttttctccaatgattttatgcctaaattagttttaattaaatctatcatcaaattaatttctgctacttttttgttattgctttgttcatttaccttgtcattttcctatttcaaatataagtcttgcctggtcaaagacgtgtaagaaagtcctaaagaaatgacaagtattatatttagcaactttttgagttttgctttctttaagacttaaagacactagaaaccccctataaagaattataaatgataagtattatgcttgacaactttttagattgccttctacacggtgagtaaaataatattcctaaaataaacaataattactatgggtagttattgtcgagtcttcccttcatcaaaacgttaaaaaaaattataaggtaaataacaaaatattccacaccagttcaaggataatgaatgagaactttgtgatcgtgctaaatgcagttctatggtagttccttgatatcaaaattaggatgttagctgtaattaaggactttgtttctcaaattaattagtgtgagtttgaatctggatgtaataagtagtaactcatgtctctttaagtatctatatataattctttttttcctcttcaatttttttttatattaactaaatcccttttgttgaggttgattagatttttacagatcatgttaacctttaattagaatgattaataaaattttgtttggaatttgaagtatctccactcttttaaatgtttgaagacaaacattttgtttaactttgggatatgagtttgccaatctaatctacttatttcattgttatcattaattttgtgttgagataaataaattacttgaatcaagacacgtcaattttattaaaatagtatgtcaagtttcaaaaattaattgagatgaacaaagattacaataatttttaaacatagtttataaaaaaaaacatctttgttttatatagtttatgatttaaaatcaaaagttaaatcaaatcttaattagaattaattagttttaaatatttgtatttaaaagggataaaaatataaaaagactcttggaacgcgattgcgcggcatagtcgccggtgccgacggctttggccacccggctattggagccatcggcgccgatcacgacgtcgacggatagggagtggcgcgaggagccgttggtggtgtagtggacggtgtagggccgtccggcgctgcggggaggtcgaggccggagacctcgatagcgacggcgacgtgcacgcgggagcggaggaaggagttgaggacctcgcggcggagcatggcgatgaactcgtggggttttagggttttgccgaagtcgacggcattgttggaaggggagaagatatgcatgcgcgtcacgtggcggtcgatgatgtggtgagggatgtcgaactctttgagcatgcagagaggcatggcgccgccgcaccgcttcgcgacggacggcggttgcgttcgaagaggaaggtctcgagaccgctggacgctagggtctccaccaaggaggatccgacgaggacgccgccggtcactgccgcccggagctttcgctcgaagatggatttgaaggctgagacggtgaacgagtttaagtagggttttttgggttttgaggttgggatggagaatgtaggtaaacaaaaactagtttgaattttcgcagccatggagagtgagtttaaaattttaagttactatgtaatattgatcgggttttctggtgtaacaataattacacacaactttttatgtatttcccatttgatcatagaggatggcaaacaacttctttcataacctgttgtgttgttgtcattggactaattgtgtaacatttttttcccttttttcttttcgaaaaacctgtcacacgtactttccccgtttctcaacaaccttcataagcaaaatttatgttttcgtacttatttttcatttacggaagtaaaaacaaacaaaaaagaatcactcatagtactttaaaaaaatgaaaaataagaagaggcgttttgaactcctttgtaaagaagctgccagtaagatggtcaatatcccctcgtaaactgatcgtctttctaactgcacacagtcgagtttgtatttgatggctgcagatttatatatagtatttattaattttctttacacaacatcatctataatattttcaaaaactaataattcgactctaatctgacttagggtaataagctttaatgatttctcttattgataaacaccagcacttctttcatgaagagtgtgcataagcactctcaaaactagtgtgtaacctggtgacattttggtaaatatgatacgcctatcatatataaacactactctgtgcaaagcaaaaaactggagccaattgcttatttcgtccttcgatttctttcataaaatgattggtggtttgttacacatccacgagattaaaaacatgttatactattcacttgatatttatagtggtttctatattaaaggtccctcctgcagtttgtacaagaatcttgggtcatgaggctgttaggtgagtgagtgtatgcctttcactctttttattaaacttgcacttttaggggtaggtgctgcttggagaacagcaggtgtggagccagggtctacagtagccattttggggttgggaagtattggattagcagtaaggaatccacatagctttcttttgtgtgttttgtggtttattatactcaaacgctcatagcaagtgaatggtttcctaggctgccgagggagctagactttgtggagcaactaggattataggtatggatttcaacctagaaaaatatgaaactggtaacgcattatctgcttaatgataatgcttaaacaaattttgttttgtgtcattattgtgttcaaattatgtaattgattttgtgggtttgttcctctgatttactcagggaaaaagtttgggctcactgactttgtctatgctggagaaagtgaaaacaaatctgtgagccaggtctaccctcttctaggctccaatctttatttaatttagttgccttaagtcttgaaatttccttctcatatgtgcttgtttagcaggttatcatagagatgactggcgggggagctgattattgctttgaatgtgtgggaatggcatcattggtgcaagaagcatatgcttcttgtagaaaggtctctctcctctctctctctctctctctctctctctctctctctctctatccctctccctctatctatctatccatcaaagtgcccctaaaaatgccttgcactatggtttataggcagacatagtaatgtgattgaataaataactgcagaataattttggaagaaataaatatagaaacgtcacgtgatatccttccatattatacagtagattgtattagtttttttaaaaaaaaaaattgtcaaatcaatctcttaaaaaatttcttattcacttttctccaatgattttatgcctatattagttttaattaaatctgtaatcaaattaatttctgctacttttttgttattgctttgttcatttaccttgtcattttcctatttcaaatttaagtcttgatcgtcaaagacgtgtaaaaaaagtcctaaagaaatgacaagtattattatatttggcaactttttgagttttgcttttgagttaaagacgctagaaactccctataaataattataaatgataagtattatgcttgacaactttttagattgtcttctacacggtgagtaaaataatattcttaaaataaacaataattactatgggtagttattgtcgagtcttcccttcatcaagacgttaaaaaatttataagataaataacaaaatattccacaccttttcaaggataatgaatgagaactttgtgatcatgctaaatgcagttctatggtagttccttgatatcaaaattaggatgttagctgtaattaaggactttgcttctcaaattaattagtgtgagtttgaatctggatgtaataagtagtaactcatgtctctttaagtatttatataattctttttttccccttcaattttctttatattaactaaatccctattgttgaggttgattggatttttacatatcatgttaacctttaattagaatgattaataaaattttgtttggaatttgaagtatttccactcttttaaatgtttgaagacaaacattttctttaacttttggatatgaatttgccaatttaatctatttattttattgttatcattaattttgtgtagtcatgtatgatcctaaagaagaaaaaatggttgcaaaaaatatatacttgtattatatataaataaaaataataaatgttatcattattaataataactaatcaattttattaaataataaattaaagagataaataaattacgtgaatgaagacacgtcaattttattaaaatagtatgtcaaatttcaaaaattgattgagatgaacaaagattacaataatttttaaatatagtttataaaaaaaaaaaaatctttgttttatatagtttatgatttaaaatcaaaagttaaatcaaatcttaattataattaattagttttaaatatttgtatttaaaaggcataaaaatataaaaaaaactcttggaacgcgattgcgcggcatagtcgccggtgccgacagctttggccacgccgctattggagcggcgccgatcacaacgtcgacggatagggagtggcgcgaggagccgttggtggtgtagtggacggtgtagggccgtccggggctgcggggagatcgaggccggtgacgaggccggagacctcggtagcgacggcgacgtgcgcgcgggagcggaggaaggagttgaggacctcgcggcggagcatggcgatgaacttgtggggttttagggttttgccgaagtcgacggcgatgttggaaggggagaagatgtgcatgcgcgtcacgtggcagtcgatgatgtggtgagggatgtcgaactcttcgagcatgcagagagggatggcgtcgctgcaccgcttcgcgacggacagcggttgcgttcgaagaggaaggtctcgagatcgccggatgctagggtctccgtcgaggaggatccggcggggacgccgccgatcactgccgcccagagctttcggtcggagatggatttggaggctgagacggcgaacgagtttaagtagggttttttgggttttgaggttgggatggagaatgtaggtaaacaaaaactattttgaattttcgcagccatggagagtgagttaggattttggatcaatatctgtgatttagggtttgctactttgtttcctccatgtgttttaggtataacatcttacattttcttcagtaaagttgtacatttggtatctttttcaagttcttatttaatattgtaaatgcatagttttaatcgatttcagaggacaaaagcaaatgctgtcagcaccaaaagtccaaaacccattttgtgctgtgcgattttaatgaagaaatgattttcaaagcatacctagcagtgatacagtgcagtagcaccctatttctttacctctttctgtactgcatgggagggactgacatatggcttttcaattatttgcttaccccaaattgttctgaaacttttgtttatgaaacttgtatatttgagagttttgagtagagtaaatttgatatcatgaaggattgaaggtagccacaggaaatgctagacttccatgttaaccaactcatggatggtgataggacggcaaagatcaggtatcggttggccagaccaggctgcatcagctaggattttgttgactgcttgagtagggttgaacaaatcccaccaaacatgagttgaagcttgatcacaggccatgtacatggagacgcaccctatcatggcaccattcaaaccaagtctgcaacatgcactcttcatgtcttcaaaaccagtataaagaacacttgatatagttgtttcacatgagtgcttgtaaatttcttacaatataaaggaacagattggtgttgtagattctgccaggccaaagagatttcaaatgcttgacgacaatcaacattcagcataggtaaattttcaatttgaagttatcaagggaggaaaaacataccataaacccttggttcgttgataatcttcatcattccattgtaaatatcacagaacaccatctgagcatcagaaaattccgtattaagcttgcctatttgttcatccagcaatctattgtattcaaagaccaagtcattgacatgtttgacagatccacttgcattataatctccagctgatgtgtaactcccaggcccagtggcggagccaccttagaaccagcaaggaccttagcactacctaaaaaataaaatttgcagttatattgagggacaatttttttttaataattatatatacttatataattaattaagattaaaaataaaatttggcactacctaaaaaataaaatttggtattatttaaaatttgacactacctaaaattacaagctggctccgccacaggccatatgaggtgtgcatcccaaaaggcagaattcccaaacatatgatattccaggcatttgcattataaagatacctcgcagcatttgccatttggttgaccaaaatggtagcaaaatattgggaactgttctggaacattcgactcgaactggaagagtaatgaaggaatagctcaatgtaatcttctttgccgaaggagagaaaaaagatggaggattttgtaaattggagagcagtgtcctcattcagctgcagttgcaacagctgcatagtctcagaaacttggcgtagttggttgttaagagactagtggctgtagcttccctggttcatgattgtagcttgtgttgaaccaaagttgaggccaccaagaacctcctccagagatccattttgtccataaaatggccggattgatgtcaatccaatcttctcagctgcaacacaatgatcctactacatcaattagtgttaaatctgtgtgagcctgtgctaacattagttatgctcatcgtaagtcaatattgaaaagtttctgcagaaataacagataattttggtacccctctaatttaccagtgaagaacttacagaaagagatgatgcatgtgtgtgcctgatgtcacttaaacgacactatagatcatgattatggaataaattgctcaaataaatgggcagctatcgcaatacattaattcagatcacattatgcagaaaaaaatgaaaggaaatatgctttcattcaccatgataggacttataagaatcactgaaagaagatttattttatcctgacacgaatgcaatggttccaaattataacttcctgcatcctgcatgtgagatttcagtggttctgtccaatttgcttgaatcacgaatgcagagtccaaatgatgaagaaaaacataaagaaaagtaccaagtagttgaggaagaagggtggcatcggagccgttacatggatacaaagagagacgaccatgaagcagagggtagaacagagtgttgtctccacaatcaaccgaggaatcccctaacacagtcaatgctgatacatgtgagctatacgtcacattagcattggtaattggtgtgcctgtcgactgtccatgaactatgcagagaatgaccattagcagaactgcaggagcagaatgaacaaacaataaacctcctcatatagtttacctactttttccttttgttttgtccactcgaattgctttgaccgaactgatttgatgctataacgttggtgttacagctaaaccatttaagtagggataaggaacttgtttgatccaaagtggtaagaagccaaagatttgcatttgattatctcagtttaaaaatgtaagttactatgtaatattgatcggtgtttctggtgtaacaataattacacacaactttttatgtattccccatttgatcatagaggaaggaaaacaacttctttcataacctgttgtgttgtcattggactaattgtctaactttttttttccttttttcttttcgaaaaacctgtcacaccttccccgtttctcaacaaccttcataagcaaaatttatgttttcgtacttatttttcatttacggaggtaaaaacaaacaaaaaagaatcacccatagtactttaaaaaaatgaaaaataagaagaggcgttttgaactcctttgtaaagaagcctccagttacatggtcaatatcccctcgtaaactgttcgtctttctaactgcacacagtcgagtttgtatttgatggctgcagatttttatatagtatttattaattttctttacacaacatcatctataatattttcaaatactaataattcgaatctaatctgacttagggtaataagctttaatgatttctcttattgataaacaccagcacttctttcacgaagagtgcataagcactctcaaaactagtgtgtaacctggtgacattttggtatatacgcctatcatatataaacactactctgtgcaaaacaaaaaactgaagccaatttcttatttcgtccttcgatttctttcataaaatgattggtggtttgttacacatatccacgagattaaaaacatgttatactattcacttgatatttatagtggtttctctattaaaggtccctcttgcaatttgtacaagaatcttgggatgaggctgttgggtgagtgagtgtatgcctttcactctttttagttttataattttatttactggataatattattcaatcctaaggaaaaagaaatccactgtttattaataccctatttgtattgtatctttctgtatcaacataaacttttgcgctttactttttaggtaggtagagtaaacttttgtggtttaatatataaatgtttggtcaaactttatgtggttcttactccctagtccttacagatgtggtttctacatacatcagttgtattaagttagggggcttgtctttttgggctctattgctatatcttttattcatgtaatggcttggttttgaccagtttgtgctcaaacctttgttcttttattcaatacattactttttcctttcaaaataataataaaaaaaaaggtattctgtgttacacatgctaaaattgtttagaggcatctttgtggtctaactatcaggagtattctaaattaatcctagagaaaagattggatagttatgaggcaaattttaatgtttcaattttgatcaaggattaaataacaaagcaaagtgtgtctgcaaaccttcagatgatttaacaacagtactcgatacattgatttaagaacaaattctacgactaattatatttatctttgctacctatttttgtgttggttgccaacgatttgccaccttgagccccattatatcttctgcatattatattatagaagctgatgatgatgttctagctaattttgatatgatccagggttgtggaaagcgtaggagaggatgtaaccgaagtcacaaaaggatatgtggttgttccaattttcttacctgattgtggggattgtatagattgcaaatcaagcaagagcaacctttgttcaaagtttcctttcgaggtgtctccttggatgcctagacatgccacctctagattcacggatttaaaaggagatatcataccccatttcttgtttgcgtctagttttagtgagtataccgtggttgacattgctcatctaaccaagattgatccagcaataccacccaacagggcaggcctacttagttgtggtgtatcaacatgtaatttgcctaaaccatgcaaaattgtaaacattaaacaaaaagaatattgaagaactatatcagttgcataataaaaattatagtcagaatatcttatcataaataaacacatggttgtattcacattttaattcactactcaacaacgttcatctaattcagtattttgattaaacttgcacttttaggggtaggtgctgcttggagaacagcaggtgtggagccagggtctacagtagccatttttgggttgggaagtattggattagcagtaaggaatccacatagctttttttgtgtgtgttttgtggtttattatactcaaacgctcatagcaagtgactggtttcctaggttgccgagggagctagactttgtggagcaactaggattataggtgtggatttcaacccagaaaaatatgaaactggtaatgcattatctgcttaatgatagtgcttatacaaatttgttttgtgtcattattgtgctcaaattatataattgattttgcgggtttgttcttctgatttactcaggaaaaaagtttggactcactgactttgtccatgctggacaaagtaaaaacaaatctgtgagccaggtctaccctcttctaggctccaatctttatttaatttagttgccttaagtcttgaaatttcattctcatatgtgcttgtttagcaggttatcatagagatgactggcgggggagctgattattgctttgaatgtgttggaatggcatcattggtgcaagaagcatatgcttcttgcaaaaaggtctctctcctctctctctctctctctctatccctctccctctatctatctatttgtctatctatctatctatctctcaaagtgcccctaaacatgccttgcaagatggtttataggccgacagagtaatgtgattgaatgaataactgcagaataattttaaaggatcaacctagcactaaaagtagcactagtaataggttttcttttgtgctatctaatttgaaattcatggtacttgatgaaaatgaagtttcctgtcaaattgagacaggtttgattggaaattttaataataaactcttatcacatgcaaacttgttgaatgttgttaaaactgatgctttccctacagggttggggaaaaacaatagttttaggagtggacaagccaggatccacgttgagccttagttgtaatgaggtcttccatagtgggaagagcctcgtggggtgcttatttggaggactcaaacccaagtctgacgtacctattctccttaaacgctacctggacaaggtactttgtgcaatttcttttaatttttttcagtgtatgctcttgatcccttctattaacatagtgatgactaagtaaaataataatgccataaaacaaagttttcaggatgcatttgtttggtactaaatttcatctgcaattatcaacaggaactgaatttggatgggtttgtcacacacgaggtggagttcaaggatatcaacaaagcctttgatttatcggttgaaggacagtgtcttcgatgtgtgattagacggacagataagctcattattgtataagtttattgttgctttacttaagcccttgaattatgacatcaaaaatgaaattttgtatactgttcttttgtatttgaataaaacaattcttaaagaagtgttggtgaattggtgatcaatccaccatcccatcaaattcaaaagtgcctccgttagaaggttacataataatacagtacacagaaattacacaaacaaattatttagaacatgtttggaaacacgttttggatcaacgttcaagcagcaaaaccacgtaaaaatgacgcagaagctacatgcacttagtgggatttccgaagtcatagtatcaaactctccatgcttggtgtttccaacactttagatctcaccaagctcccaatggtattgacgaaaagcttagcatcatccaacactctcccacgtgccaacttcttatacaaatagttctcaaacatcatgcgttgaacatactcatcctcacacagttccaccagagccttcctggacacgttactacgtagaaaaccctctgcagcatgtgcgcgggagcggaggaaggagtcgatcgaggacctcgcagcagagcatggggatgaacttgtggggttttagggttttgcagaagtcgacgatgatgttggaaggggagaagatgcgcatgaacgtcacgtggcggtcgatgaggtggtgaggaatgtcaaactcttcgagcatgcagagagggatggcgcgccgcacggcttcacgacggacgctgggttgcgttcgaagaggaaggtctggatgccgtcggaggctagggcctctgctgcggaggatccagcgaggccaccatcaatcactgttgcccggagctttcggctagagatggatttggaggctgagatggtgaacgagtttaagcaggcttttgaggttggaatggagaatgtaggtaaacaaaaactagtttgaattttcgcagccatggagagagttaggattttggatcaatatctgtgatttagggttttctactttgttccttccatgtgttttagtaataatatattaataattacattttctttagtaaagttgtatatatattgggaatttttttttcaagttcttatttaatattgtaaatgcatagtttaatgttctaataaagaaatgatttccaaagcatacccaacagtgttgcagtgccgtagcaccctatttcttttataaaaaaattactgcataggcctagctagcatatggctttacaattatttgctacccctaaatgttctgaaacttttgtttatgaaacttgtatatttgagagttttaggtagtgtaaatttgacatcatgaaggttacgggtgtttatggattggattttaaaaaataatacattacagcccaagagcattccaaatagcaacccacaagagtatgaagcagaaaaataagatgcagccaaaagaaaaggaagactttggaatgatgctagctagaaagtaaccttaaggagctaagtaccttgtataaaaatttaattatttttattcttatgttactttcattttcaattttctttttctacttttctcagtagttttgatgcctgaacaacattcatcatgaactaattacatctgaaaatagaatgatacaattgtacatttaattgtgttagcctaaattcttccagcaaacagtacatatgttcctaatataatgccaactgtgtgccgattgaaggttcaatgtgcaaattttccttgatgcttatgcaggttaccctagataatttacggaaaattagttacctgaaattaaaacaaaagcattcatcacattttttttcttcttatttgcaaacaacttgaaatagatcacttaggtgagatttcttccacaaaagacaaaagttaaaattacagaaaacaagtcgcatcgcacacgaaagaatcatattaaatttatttttatatcattaaaatccatcataaataaataattttaaaattcagctaataaaaagtgtttcagcaattttttcatatataaattatattttaaatttataatgaataatttaaattatgatataatattatttttaaaaattgataatttatttttataagaactattgaaattcaattttaaaatagtgataaaatatagtagatgaaaagagacaaactattaagatgtttaaacataaaatacagataaagaaaaatgacagattgagatgttttaatttacagtaataatgtgtgaaattcacatccagaatctagatgatcagaatgtttaattaaagtggagagagtgtgactcacgtttcacgtgaaccattttttaaaggaaaaaattacgtttaacaaatggatttaagacgccaaaatggagtctgtaaaactttttggctgttgtgaaatgctagaaagtccttttgacaaatctttaatcattgagtgaattttacgtaaatcccatcactcaaattttgtaatagaattcacatcaaatttagccaataataaaaaaatgttaaacaagagtatattgttagtattactttttatttattttatcttttgatatgaatttttaataggtttccaatattttttttgaaatgcaaaactgaataatagaatctgaatatatatagtataagggtataaaattgttttcaatatttggacattgctagggtatataaatttcagaagtagaactatgtttttaatttcaagatcaatattcagtcgtttgctgtgtgcatattagtatatgatcaatattgtttctttttttggtccaaatatctatcaatatcgtttcaactttcaaatatgaaaagtggcagcctttagaacattaccaggccattgttatggtgactttgatgttatggtgacacattggcttgggcgcatctacgatcaccatgcagcaaaattaatcaataagcagcaaaattaatcaataattgatctgagtttgatagggatagttgtttggagaaagcatgtaatatggttaggagaaacctttcaaaatgtgagagatttctactttctactactactaatgttatatcttatttagttgggagagattatatcacaagggtataagtatgtttgtttaaattggggatgcaaactgtacaaggggagacatttggtgttgtgaggacagaaaaattagagaaatcttaaaaaaaataatgagatggttatttaaaaattttaattgagagaagaattgttgaagagcaatttaaatttcaaaataaatgtaggagaagattaaaggagattttttaagatatttactatattcaaatttttaggattttatctagatttaattattttattaatttttttttacttattttagagattttttttaaggttaggatggtgataatatttgaatattgtattgttatttaactctatatatggaaccaagaaagaaagaaaaaaatcctacaatgtatttcatctaagatcccttgggtgtgtgggtaattttgctgtgcgtggtggagtttttcctaacacattgttatggtgacgttggtttatttattttcgcttaaggaacctcccaaagggacacagtggcctgggcacatctacgatcatcattcagcaaaattaatcaataattagactgagttggttaggaattgttgtttggagaaagtatgtaataacaggggtaggtgaaaccaatttttaatttaaaagtccacttttagtcatagctcgtattatggcatttgtgacacggtatatgtctgtattcaagaggtggctaataagtttttatctttggagataggcatcaaagtctttgagccaataatatgggatgatcactcattttgatatcttctcgctaggaatgaaaagattatcgtctcccacgtgtgttattaggaacctagtaaaattcacttagagttagttaatcacttaacttattatggttaattacttgttagtcgcttaatagatagtataaataagagcaccatataccttctctgtattttaatcaatcaatgtgcgtgcaacctcttgagatttgttccattacttggcctatgcctgtgatatgtatccctctcatcctctgatcactaacatttgtctctgatattatgtttatttatttattttaattttaaaaaacaattgaggtacattatctgattctaatgttatctcaacccttaatttcaagaacatggttaccctctggtgcctttgtctagaaattttgtaatgcatatggatcagtctttccagaggctgtatcaggatcaattatcaacttcaatatctgtttgtagaacagagagttgaaagaaggttttaactcaagtcacttgtatgtaaattctccatcgtttactgttaaatactttgtttcaaggatagccttgtgtttttgcaaataagaaaatcctactctttctggttggagttttggcataaagtcctttcactaagcaaaaacataccgatcttaaactaatggaattttctgtagtgctgttagtaaagaaaaagacagaagacccacagaaccttcatccgcagtgaattctaaaactaccgaaaggttggttttctacttcttttcacagtagctttgatgctgaacagcattcatcatgaactaactatatctgaaaatacaatgatacaattgtacatttaattgggttaccagaattcttccagagaactgtatataaattcctaatataatgtcaatttacggaaaattaattgcttgaaattgaaaccaaagaactcatcacattttttttttcttatttggaaacaacttgaaatggatcactcaccagagaatatttcttccacagacagaagttaaaattacagaaaacatacagactcacaaaagaaccataataaactaagagtagactatttttttcccctatgatttgtccttttcactcttaattaattaagcacaccttcaacaagctcgctagccattgtggtttcccagtcattaaaacattatatcccaaaagcattccaaatagaaacccacatgcatatccaactgctacagctttccagccaaatcctgattcttcatggtgaaatgttgaatgtggtggcctttcttgatcctcattgcaggattttgacaaaggggatccacatagcattggatttccaacataggaatcattttcaaatgtgttaaattgtccacctttaggtatgattccctcaaggtggttttgtgagaggttcaacacagccagaaaattcaaattggtaaaagccacaggaatctctcctgttaactggttccatgaaaggtccaaccattccaaatttcttaaattaccaaaggatcgtggaatggtaccagtgattgcattgtgcgaaaggttaagccctatgagagaatgcaattctccaatgactttcggaagttctccttcaaatttattatttgataaatcaatggttgtgaaaatagttaatatcctcttgagctccacgaattgacctttcattacaaccactactgaatcattatagtaatcggcgttacccatatatgtcaaaccagtttggttgtcattcacactcaccattccttgaaagttcttgatgtatgatgctggcaagggcccactaaaattgttatttgagacatcaaaaattctcagcctgggaaatggatgcttggcaccgaaacaagtgatgacaccatgaaacttatttgatcgcaaactgagtacctgtaaccgctggaggctttctagccaatggggaaatgtatcctctatgttattgtctgccaggtccaaaacttccagccttgtgcagtgggccaaagaccgtggtaatggtccatccaattggttgccattcaactttatagtctccaattcatgtaagtaataagaaaagttcccaggtatgttgccgtaaaggttgttcttttgcaaatccaatgcccaaagaaaaggcaatgttcccaggcatggcggaatctggcctgtcaagttgttatgagccaagttgagtatatggaggccgcttgcattgcacattgctgaaggaatgttcccagtcagctcattatttgagactaaaaagttctgaatgccgggtggaattgggagatcgccttgcaacttgttgaaactgaggtcaatatatctcatgttatgaaaccacgggggaatgcttccacgaatgttgttatgagaaagatctagtgagatcagattttgaagtagtgctaagaatttagggaaagtattaatattacaggaagataaatataagattttaaggttgggtaagatgtagtcagcggtactatcgaagttaatagagagaaaattattgtgagaaagatcgaggcgctctagatttttgaacattgaaaattgatgaaagtccagatgaccactcaagtcaattgaccccgtgaggtagttgttgctaacatccaaccatagcaaggaaggcaaaaaataacaccaatatggaatggggccaactaattcattaaatgatagatctaaagtgtagagttgagttagattaaagacggatgagggaagcagtccatcaaaattgcaaccccccagatctagtgtgacaagagacttcaaatggccaatggaaccggggatgtttcccgagaaagcagtctcagagagatccaagtaaattagtggagtactccagtttgactttggaagttcacctctcagcttttcattttcatgcaaatctagtttttgaagattgggtaaagagaggatgtcactcgacagattcccttgcaatttggtgtctgcaagactaagggagaccaaagaggaagagagattggttagcaatgacaaagagctctctccgatacaagacatgtccacgccatctaaagtaagctctcttaaattagttgcgttttgaatgagcttcttccatgtgtatggatcaattctcattctcgggcggttgggatcatcatttatattgtagagatcaagtgacagtaatttggacaagtgagagattgtggagggaatgtcaccaaaaatataatcaaaggataggtcaagaccaatcacgtggcctgagatggtgtcgcacgtgaccccattccactcacaacaatctgttccgttgttccaagattttgttttggaaggaaaatcatttgaagtgttgagtgagtatttgagttgtagcaaggcagagctgtcatcatggttgcagaaagaggaagaagaagaaggaagaaaaagaagaagaagaagaaggaagagaaagtatgggagtagaacccaccaaacattcttattcatattcatcctttcaactcaacaacaaaactatacaggatttttggatgcaaccatttcaattcacgaacttctatttatagcctacgctgcttcaaagcctttcatttcgatttaactctttctttgctttttcttccttcgcctgtgatataataatatatttgtaaatcattatcaaattaattttatgttatttagatataataatatatttgtaaatcatttttgctttgaacattggatggacaacttcctcaatgcactcatcgtgaaggttgtttagcgagaatgaatcaatggaggctattggtgtgaaacagtcattatcgcggtattcgtattcatcatgttcctgtattgatgaaatcaaaccttttttctttaaaaatgtgataattttatttagtctttaagagaatatatgtttattatatagattcacaatttcataattttcttcataatcttgggatttgaatcatttattcaaaaataaccatgcctaaaaacactattatttaatagaagaattcgaattataataaaaaacatattaattacaccaagagttgtaaattgattattaaacataactatatcaaataattaaaaggttactaaaattgtctttttcttttttttacttttacaaagagaaatatttaaatttattgctttaaaattttatttgatatcacactagttttctttttcaaaaaatctgttaaaaatgatttcttaagatttcttcgtcatcatcttagttctccaattattttatgaccttaaaagtttagtctatcgtccgtaaaaaacaaaaaaagtttagtctagtatcaagttaattcctcaattttttatgtaactactcttttcatttattttgttatttctctagttcgtattttttaatgacaagtaacatgtttgataattctttaatagaaacttgtaaaatgattatattttatttttgtactttgggtcacaattatattgaacggggcacaaaaaaaaaagagtaaccatttttgaatattttatttttgtaaacacaaaattaacactcattatttttgtctctattttttttttattacattatgtcacttatagtgctgtcatttgaaacggacctaataaagaagaaagttaaaaagcaatgagcactcaatatcatatcaaagacgaagacgcaatagtgataaagtaaacagcgtgtcaatgcattattagttacttttaatttttgtttcagatatacaagtgcttcatacaactttaattctaaagttgcaagaacgttaaatcatgaataatgataacaatcgacagtctaaaccgcgtaaattgtggttcgtgtatattttaagaaatatttaaatatatttttacataaatatatgtttccaaaaatattattatctggagcattattttatataatatttttatttactacgatgatgtcttacatatttttcttttgatcgttttttttttaaaaacaaattgacttaattatttttatgatttgcactcttgattttggataacaaaaaattgagtgaaaatttttaattacaatagaattcttttgtatttaatttatctttttaagtttcaaacatcatctaaaaatgttttaacagtaaaaaatgttattaaaaaatgtcatttaattttgattgtgattggaatggaaggaaaaaatatattatattaatgttaattatttgaattgatacttcacaatttgattaattttaaattaaattattttaaaatttaatttcatatatatttgcattatgatatttttcctttgaaattgaattatttccaaaaatatattaaatcattttccacataaattttgtttttagttttattatggttaattctattttaaattaaattagtttaaaaataatttgttcattaaatattttcatgaataactattataagaaatgaaactttattaaaataaataaatatttttgtcattaaaattcaatcaaatattcacggagaaatattttttcatcaatcatacaatcttgtataattttcatttgcaaagtctaaattttagtatgataaaaaatattattaaataattttatataattatttaagaacaattcttaaatattttcgtgaataaatttcataagaaatgaaactttattaaaataaataatttttttcatgattaaatttcaaccaaatattcatggatcggagggatatattttcatcaataataaattcctgattaaatttcttttgcaaggtctaaattttagtatagtaaaaaatgttattaaataattttgaataattattttataacaatcgttaccacggataccataatttgacgtattattatggaactaaaatatacataaaattaaaattatatttataacagcctctctctctctttcctttagccttctctctctttcctttcttccttttctctgcttctgacattgatgaattagagaagcttcttaaacactcaaccgttgaccaaaacctttcacacccaacatgaaagttgaaaggaactactcaatgagttagatttcatcatcacttttctctgaaaatcatcaaacaaagagatcaagttctctagggaactttaagaaaactgagtttagaagggaaagaaggtgattcaaggacgccaaagcttggagaagagatccttcacccttcctcgactgtttagaggtaagaaactcaagttttgccgattgatttgagaatttgttcttggggtgaataatgaccattttgtgatagggctgagattagacttgggttctttagaaaagtatgctcaggaggctgttctgatgaattttaaactttgaaacatgttttttgattaagtttgattttgactatgagtttggtatgggtaggaaaaatgttgagtaaatggaagatattatgatagttatgagcctaagtgcctttacaaaagttgttcagaaggccaaataaacggtgaaaatgtgttgatatatctgttttagtcatgttggaaaattgttgaaatatggtctggttaggtcatgaaattggtttatgcagagttttagagtgactataatgcttggttaggctggaacagatcttgctgagggtctgtgagtcgcctataaggtggatagttcaggtaaccttaagttagagaacaaaaaggtgtaatggaaaggaatgacgtttcttttcattctaaacggttgagaaccgttattgattggttgtttgtatgtcttgtgtagggcatgatacagacattactggtggttgtgaccacgaagccgggagagccggtaagctctttgtttttgggagtgtttcccactgtttgtgttccaccatactctgagagagtgatggttattgtatatcatgatgcatgtatattgaaattgtgtattactattttatgataatatgtatatgatgagctgaacactgtgatagtattgtatatgtgattgatgagattctctggccagtagaattatgtttaatagactgtatatatatataagtcttgatgtgagatgtgtctacatagttggatgaagcctcctcaggcaagaatgaaagtcctgctgtgagatgtgcccacatagtggatgaagcctcctcaggaattgatatatatatagatatatatatatatatatatatttgtatatgtgctatgtacatgtggtaatatggcttgatagctgtgattactagtttgtaatgccaattttgatattatatgctatggaagtgaaccaggggggagaaaagacctccaaggaccctgagtctactgagattgttatctcacccctgttgggggttatgttttgcaggtgatactcagggagccgctgaaagatcccagggcaagaggcccgagcagggataggttctgtgagaaccttaggcatagtgtttaagagcatgttggctctatcttttgattcatgcctgttattttgtatcttgatagagattttgtatagtttttgaaatatacattgtatattataggaattcactatatataatgtacaattgttgttaatgatgcttgatgacgtcatgttgcttattgcttccgaattaattatttgtgataatcgctgcgcttaataaccataaatcaatgttaatgcacaggatgcatacagggtgttacaatattaaaaaattaaaattaaattcatataatagttaatgtaaaaaattaattgcaaaatatttttttattaattctcctgaaagaaatatattataattaaggtgactatttaaaagataactattattaatgaataaataaaaaatgatattgattacatttatcattaaatttattattttgggagaaataaatatagaaacgtcacgtgatatcctttcatgttatacagtagattgtattagttttttttttttaaaaatagttgtcaaatcaatctcttaaaaaaatttcttattcacttttctccaatgattttatgcctaaattagttttaattaaatctaccatcaaattaatttctgctacttttttgttattgctttgttcatttaccttgtcattttcctatttcaaatttaagtcttgacctcgtcaaagacgtgtaaaaatggtcctaaagaaatgacaagtattattatatttggcaactttttgagttttgcttttgagttaaagacactagctagaaactccctataaagaattagaaatgataagcattatgcttgacaactttttagattgtcttctacacggtgagtaaaataatattcttaaaataaacaataattactatgggtagttattgtcgagtcttcccttcatcaagacgtcaaaaaatttataagataaataacaaaatattccacaccttttcaaggataatgaatgagaactttgtgatcatgctaaatgcagttctatggtggttccttgatatcaaaattaggatgttagctgtaattaaggactttgcttctcaaattaattagtgtgagtttgaatctggatgtaataagtagtaactcatgtctctttaagtatttatataattctttttttcccctgcaattttctttatattaactaaataccttttgttgaggttgattagatttttacatatcaagttaacctttaattagaatgattaataaaattttgtttggaatttgaagtatttccactcttttaaatgtttgaagacaaacattttctttaacttttggatatgaatttgccaatttaatctatttattttattgttatctttaattttgtgtagtcatgtatgatcctaaagaagaaaaaatggttgcaaaaaatatatacttgtattatatataaataaaaataataaatgttatcattattaataataactaatcaattttattaaataataaattaaacagataaataaattacttgaatgaagacacgtcaattttattaaaatagtatgtcaaatttcaaaaattgattgagatgaacaaagattacaataatttttaaatatagtttataaaaaaaaaacatatttgttttatatagtttatgatttaaaatcaaaagttaaatcaaatcttaattagaattaattagttttaaatattagtatttaaaaggtataaaaatatacaaaggctcttggaacgcgattgcgcggcatagtcgccggtgccaacggctttggccacgccgctattggagcggcgccaatcacgacgtcgacggatagggagtggcgcgaggagccgttggtggtgtagtggacggtgtagggccgtccggggctgcggggagatcgaggccggtgacgaggccggagacctcggtagcgacggcgacgtgcgcgcgggagcggaggaaggagttgaggacctcgtggcggagcatggcgatgaactcgtggggttttagggttttgccgaagtcgacggcgatgttggaagggaagaagatgtgcatgcgcgtcacgtggcggtcgatgatgtggtgagggatgtcgaactcttcgagcatgcagagagggatggcgccgccgcaccgcttcgcgacggacggcggttgcgttcgaagaggaaggtctcgagatcgccggatgctagggtctccgccgaggaggatccggcggggatgccgccgatcactgccgcccggagctttcggtcggagatggatttggaggctgagatggtgaacgagtttaagtagggttttttgggttttgaggttgggatggagaatgtaggtaaacaaaaactattttgaattttcgcagccatggagagtgagttaggattttggatcaatatctgtgatttagagtttgctactttgttccctccatgtgttttagtaataacatcttacattttcttcagtaaagttgtacatttggtatctttttcaagttcttatttaatattgtaaatgcatagttttaatcgatttcagaggacaaaagcaaatgctgtcagcaccaaaagtccaaaacccattttgtgctgtgcgattttaatgaagaaatgattttcaaagcatacctagcagtgatacagtgcagtagcaccctatttctttacctctttctgtactgcatgggactgacatatggcttttcaattatttgcttaccccaaattgttctgaaacttttgtttatgaaacttgtatatttgagagttttgagtagagtaaatttgatatcatgaaggattgaaggtagccacaggaaatgcttgacttccatgttaaccaactcatggatggtgataggacggcaaagatcaggtatcggttggccagaccaggctgcatcagctaggattttgttgactgcttgagtagggttgaacaaatcccaccaaacatgagttgaagcttgatcacaggccatgtacatggagacacaccctatcatggcaccattcaaaccaagtctgcaacatgcactcttcatgtcttcaaaaccagtataaagaacacttgatatagttgtttcacatgagtgcttgtaaatttcttacaatataaaggaacagattggtgttgtagattctgccaggccaaagagatttcaaatgcttgacgacaatcaacattcagcataggtaaattttcaatttgaagttatcaagggaggaaaaacataccataaacccttggttcgttgataatcttcatcattccattgtaaacatcacagaacaccatctgagcatcagaaaattccgtattaagcttgcctatttgttcatccagcaatctattgtattcaaagaccaagtcattgacatgttcgacagatccacttgcattataatctccagctgatgtgtaactcccaggcccagtggcggagccaccttagaaccagtaaggaccttagcactacctaaaaaataaaatttgcagttgttttgagggacaaatttttttaataattatatatacttatataattaattaagattaaaaataaaatttggcactacctaaaaaataaaatttggtactacttaaaatttgacactacctaaaattacaagctggctccgccacaggccagaccaggtgtgcatcccaaaaggcagaattcccaaacatatgatattcctggcatttgcattataaagatacctcgcagcatttgccatttggttgacaaaaatgatagcaaaatattgggaactgttctggaacattcgactcgaactggaagagttatgaaggaatagctcaatgtaatcttctttgccgaaggagagaaaaaagatggaggattttgtaaattggagagcagtgtcctcattcagctgcaattgcaacagctgcatagtctcagaaacttggaacagtggccaaaatgccacttttggcaaaaaaatttgccagaatgccacgaatccgaaattaaatgccaaaatgccacacagagtagttcgctggccagaaaagcgaaatccatgtgccacgtggcgttccgccatttgaagaccaaattcgctggaggggcatgcgaaatatgacctgtcagcgccttcaatgccacgtgtcacgacctgatagttcgctgacacacccagcgaattacgttgcatgtgccacatgtcagctttccattggttgtaagcaatatatttaaaatttaaaaaatgcgtataaactttggaaggccataacttttgactgggatgtccgattgaggcgaaatcggtggtcacgcgatcgtaattgagaggcgatgccgttggcaagtgcccaaagaggacttgcccaaattttttttccaaaaggggtctctaagtgcctcaaaattacgatttaagattcaaacatccaaaaatttctttttttctaattttttattttttcaattagtgaattgcatgctattttttatttttttagttacttctcttactttcgagcgttttgacatatcgtacgcttccatcagacattcctaacaaaaaatatcgttgcccaaagtttatacgcattttttaaattttaaatatattgcttacaaccaatggagagctgacacgtggcacatgccatgtaattcgctgggtgtgtcagcgaactatcagggcgtgacacgtggcattgaaggcgctgacaggtcatatttcgcaggccccctagcgaatttggtcttcaaatggcggaacgccaagtggcccatggatttctcttttctagccagcgaactactccgtgtggcattttggcatttaatttcggatccgtggcattctggcaaatttttttgccaaaagtggcattttggccactgttcccagaaacttggcgtaattgttggttaagagactggtggctgtagcttccctggttcatgattgagcttgtgttgaaccaaagttgaggccaccaagaacctcctccagagatccattttgtccataaaatggccggattgatgtcaatccaatcttctcagctgcaacacaatgatcccgctgcatcaattagtgttaaatctgtgtgagcctgtgctaacattagttatgctcatcgtaagtcaatattgaaaagtttctgcagaaataacagataattttggtacccctctaatttaccagtgaagaacttacagaaagagatgatgcatgtgtgtgcctgatgtcacttaaacgacactatagatcatgattatggaataaattgctcaaataaatgggcagctatcgcaatacattaattcagatcacattatgcagaaaaaaatgaaaggaaatatgctttcattcaccatgataggacttataagaatcactgaaagcagatttattttatcctgacacgaatgcaatggttccaaattataacttcctgcatcctgcatgtgagatttcagtggttctgtccaatttgcttgaatcacgaatgcagagtccaaatgatgaagaaaaagataaagaaaagtaccaagtagttgaggaagaagggtggcatcggagcctttacatggatacaaagagagacgaccatgaagcagagggtagaacagagtgttgtctccacaatcaaccgaggcttcccctaacacatacaaagctgatacatgtgagctattcgtcacattagcattggtaattggtgtgtctgtcgactgtccatgaactatgcagagaatgacctttagcagaactgcaggagcagaatgaacaaataataaacctcctcatatagtttgcctactttttccttttgttttgtccactcgaattgctttgaccgaactgatttgatgctataacgttggtgttacagctaaaccatttaagtagggataaggaacttgtttgatccaaagtggtaagaagccaaagatttgcacgattatctcagtttaaaaatgtaagttactatgtaatattgatcggtttttctggtgtaacaataagtacacacaactttttatgtatttcccatttgatcatagaggaaggaaaacaacttctttcataacctgttgtgttgtcattggactaattgtctaactttttttttccttttttcttttcgaaaaacctgtcacaccttccccgtttctcaacaaccttcataagcaaaatttatgttttcgtacttatttttcatttacggaggtaaaaacaaacaaaaaagaatcacccatagtactttaaaaaaatgaaaaataagaagaggcgttttgaactcctttgtaaagaagcctccagttacatggtcaataccccctcgtaaactgttcgtctttctaactgcacacagtcgagtttgtatttgatggctgcagatttttatatagtatttattaattttctttacacaacatcatctataatattttcaaatactaataattcgaatctaatctgacttagggtaataagctttaatgatatctcttattgataaacaccagcacttctttcatgaagagtgcataagcactctcaaaactagtgtgtaacctggtgacattttggtaaatatgatacgcctatcatatataaacactactctgtgcaaaacaaaaaactgaagccaatttcttatttcttccttcgatttctttcataaaatgattggtggtttgttacacacatccacgagattaaaaacatgttatactattcacttgatatttatagtggtttctatattaaaggtccctcctgcaatttgtacaagaatcttgggatgaggctgttgggtgagtgagtgtatgcctttcactctttttagttttataattttatttactggataatattattcaatcctaaggaaaaagaaatccactgtttattaataccctatttgtattgtatctttctgtatcaacataaactattgcgctttactttttaggtaggtagagtaaacttttgtggtttaatatataaatgtttggtcaaactttatgtggttctcactccctagtccttacagatgtggtttctacatacatcagttgtattaagttagggggcttgtctttttgggctctattgctatatcttttattcatgtaatggcttggttttgaccagtttgtgctcaaacctttgttcttttattcaatacattactttttcctttcaaaataataaaaaaaaaggtattctgtgttacacatgctaaaattgtttagaggcatctttgtggtctaactatcaggagtagttaattttctaaattcaatcctagagaaaagattggatagttatgaggcaaattttaatgtttcaattttgatcaaggattaaataacaaagcaaagtgtgtctgcaaaccttcagatgatttaacaacagtaatcgatacattgatttaagaacaaattctacgactaattatatttatctttgctacctatttttgtgttggttgccaacgatttgccaccttgagccccattatatcttctgcatattatattatagaagctgatgatgatgttctagctaattttgatatgatccagggttgtggaaagcgtaggagaggatgtaaccgaagtcacaaaaggatatgtggttgttccaattttcttacctgattgtggggattgtatagattgcaaatcaagcaagagcaacctttgttcaaagtttcctttcgaggtgtctccttggatgcctagacatgccacctctagattcacggatttaaaaggagatatcataccccatttcttgtttgcgtctagttttagtgagtataccgtggttgacattgctcatctaaccaagattgatccagcaataccacccaacagggcaggcctacttagttgtggtgtatcaacatgtaatttgcctaaaccatgcaaaattgtaaacattaaacaaaaagaatattgaagaactatatcagttgcataataaaaattatagtcagaatatcttatcataaataaacaaatggttgtattcacattttaattcactactcaacaacgttcatctaattcagtattttgattaaacttgcacttttaggggtaggtgctgcttggagaacagcaggtgtggagccagggtctacagtagccatttttgggttgggaagtattggattagcagtaaggaatccacatggctttttttgtgtgtgttttgtggtttattatactcaaacgctcatagcaagtgactggtttcctaggttgccgagggagctagactttgtggagcaactaggattataggtgtggatttcaacccagcaaaatatgaaactggtaatgcattatctgcttaatgataatgcttatacaaatttgttttgtgtcattattgtgctcaaattatataattgattttgtgggtttgttcttctgatttactcaggaaaaaagtttggactcactgactttgtccatgctggacaaagtaaaaacaaatctgtgagccaggtctaccctcttctaggctccaatctttatttaatttagttgccttaagtcttgaaatttcattctcatatgtgcttgtttagcaggttatcatagagatgactggcgggggagctgattattgctttgaatgtgttggaatggcatcattggtgcaagaagcatatgcttcttgcaaaaaggtctctctcctctctctctctatccctctccctctatctatctatttgtctatctatctatctatctctcaaagtgcccctaaacatgccttgcaagatggtttataggctgacagagtaatgtgattgaatgaataactgcagaataattttaaaggatcaacctagcgctaaaagtagcactagtaataggttttcttttgtgctatctattttgaaattcatggtacttgataaaaatgaagtttcctgtcaaattgagacaggtttgattggaaattttaataataaactcttatcagatgcaaacttgttgaaagttgttaaaactgatgctttccctacagggttggggaaaaacaatagttttaggagtggacaagccaggatccacgttgagccttagttgtaatgaggtcctccatagtgggaagagccttgtggggtgcttatttggaggactcaaacccaagtctgacgtacctatgctccttaaacgctacctggacaaggtactttgtgcaatttcttttaattgttttcagtctatgctcttgatcccttctattaagatagtgatgactatgtaaaataataatgccatgaaacaaagttttcaggatgcatttgtttggtactaaatttcatctgcaattatcaactggaactgaatttggatgggtttgtcacacacgaggtggagttcaaggatatcaacaaagcctttgatttattgattgaaggacagtgtcttcgatgtgtgattggacggacagatgagctcattcttgtataagtttattgttgctttatttaagccctttgaattatgacattaacaaatgaaattttatatactgctcttttgtatttgaataaaacaattcttaaagaagtgttggtgaattggtgatcaattcatcattgcttcaaattcaaaagtgcctccgttagaaggttacataataatacagtacacagaaattatttagaacatgtttggaaacacgtttggatcaacgttcaagcagcaaaaccacgtaaaaatgacgcagaagctacatgcacttagtgggatttccgaagtcatagtatcaaactctacatgcgtggtgtttccaacactttagacctcaccaagctcccaacggtattgacgaaaagcttaattagcatcatccaacactctcccacgtgccaacttcttatacaaatagctctcaaacgtcatgcgttgaacatactcatccccacatagttccactagagccttcctggacgcgttactatgtagaaaaccctcagccccatgtgcgcgggagcggaggaaggagtcgaggaccacgcagcggagcatggtgatgaacttgtggggttttagggttataccgaagacgacgatgatgttggaaggggagaagatgcgcatgaacgccacgtggcggtcgatgatgtggtgaggaatgtcaaactcttcgagcatgcagagagggatggcgccgccgcacggcttcacgacggatccagcgaggtcaccatcaatcagtgtcacccggagctttcggccagagatggatttggaggctgagacggtgaacgagtttaagtagggttttgacttttgaggttggaatggagaatgtaggtaaacaaaaactagtttgaattttcgcagccatggagagagttaggattttggatcaatatctgtgatttatgggttttcttctttgttccttccatgtgttttagtaataatatatatattacattttctttattaaagttgtatattgggtaattttttttgtcgagatcagataggattattttttgttgacataagttaggattttttcggtcaacattggttttgactatttttttgttgacgttagttagatttttcagtccacattagtcaattatgtttttttgaccgacattgacgaatcatggtatttgttgatattggtcgaagctactcagctaggatatttttcgattaatgttagtcgatattatttttttggtcacatcaactaaagctattttggagggatgtcgatcaaggctatcttttcgccaattccggcttgggccatggatgccagcaaaaatggtctagattaaagttggtcaaaaatcttaatcatttcaatagaaaaaaaatcctgttaatagtctcagttgaaagtgtagcatgttgaattcctgcttcattttatatccactgcggtaattagtatggcttctagtaaacaataaaacacaaatctaatagcttgtttggaaaatctaatatacattgattctcttgtatataatatgaaataatacataattttattaactgagtaagacaattttatatttaaaggtcaaggaaaattttttagagtaaagttgagtggaacatttgtacatgaaatttggaatatgaatttcagaacatgaagagatcagattattgaacccacacaccgattcaacgcttgatgaaaggtgaaagcaaattcttcaatgaaaacccaacacttgatgtaatttaaaaaatattgtttttccaataatttacgctcttttgtgatataaattataggtcttgaacttgaactaggtattgataaggagataaataagatatgtaatgtcatttttaatggtaagatcattaatttgtggaagaataaacaagtaatatattacaagtaatatccttcctttttttttctttctattcttacactaaatttttaaattgtttaaaaaatattaaactaacacctctttttttaacacatgcacaccgttaatatattacatcaacctactttatttgttttaaaattatattgtgtctccctaaaaaagaaattgttggaaacgttaaaaaagcacgagatatttgcacaatcccatgaaatcgcataaagtatccgtgtaatttactttaatatttaccatatcaaatgtcatatcccgctagtcttgagcaggataattatatttaatgtatgtagcagcaattaatgtttttaatatgaaacataatcactatttttatagctccccattgggtgtgtaatgtaaaagtagtaaaaattgttgttggtgggaattgaaccttggacctattggttattaaaaataggcattatcatctcctttaattttcagtattgaacatatgttatagtaattaatatttgaggtccttatttttggggccctatgcggttgggcaccttaaatgggcccaaaaccgctcctggggccattgatgccagcaaaaatggtctcgattaaagttggtcaaaaatcttaatcgatttcaatagaaaaaaaaaatcatgttaatagtcttagttgaaagtgtagcatgttgaattcctgcttcattttatatccactgcggtaattagtatggcttctagtaaacaataaaacacaaatctagcttgtttggaaaatctaatgtacactgattctcttgtatgttcaattgggaaaatccaagttcttcaagaaaactgtccaacatttttcctaataaaatgctgatttttgtgatgatttaaggttggacgcgtgaattttcctcaatgcctttgcaggatacgactaattacacaatttatagcaaataaattgaacttaagacaaaattgattgatctctaaatttacttgtttgcacaaaaacttgaaatagatcacttgataatattgagagacgaaatttcattacacaaacaaagaagataaaattataaaaaaaataaaaaaaatacatacatacatactgataaacacatataatacagaaccatattaaactaatgcattccttgtcaatttgcatggattctgttattaatttgttcttttcactcctcaaataagcacaccttcaacaagtctcgctagccattgtggtttcccagtcattaaaacattatatcccaaaagcattccaaatagcaacccacatgcatatcccactgctacagctttccagccaaatcctgattcttcatggtgaaatgttgaatgtggtggccaatcttcatccttattgcaggattttgacaaagggaatccacatagcattagatttccagcatatgaatcatttccaaatgtgttaaattgtccacctgtaggtatgattccctcaaagtggttttgtgaaaggttcaacacagccagaaaattcaaattgatcaaagccacaggaatctctcctttcaactgattccacgagaggtccaaccattccaaatttcttaaataacaaaaggatcgtggaatggtaccagtgattgcattgtgcgaaaggttaagccctttgagagaatgcaattctccaatgactttcggaagttctccttcaaacatattatttgacaaatcaatggttgtgaaaatagttaatatcctctcgagctctaggtattgacctttcattacaaccactactgaatcattatagaaaccgccgttactcatatatttcaaaccagtttgggtgtcattcacactcaccattccttgaaagttcttgatgtatgatgctggcaagggcccactaaaattgttatttgagacatcaaaaattctcagcctgggaaatggatgcttggcaccgaaacaagtgatgacaccatgaaacttatttgatcgcaaactgagtacctgtaactgctggaggctttctagccaatggggaaatgtatcctctatgttattgtttgccaggtccaaaacttccagatttgtgcagtgggccaaagaccgtggtaatggtccatccaattggttgccattcaactttatagtcttcaatgcatttcccttagaaaagtttccaggaatgctgccgtaaaggttgttcttttgcaaatccaatgcccaaagagaaggaaatgttcccagacattgcggaatctggcctgtcaagttgttatgagccaagttgagtatatagagggagcttgcattgcacattgctgaaggaatattcccggtcagctcattatttgagactaaaaagtagtcaatgccattgggtggaattggaagatctccttgcaacttgttgaaactgaggtcaatatgaccaatggacttccaggagtgcaagagcttctcttgaaaccacgggggaatgcgtccacgaatgctgttatgagaaagatctagtgttgtcagatatttaagtggtgcaaagaatttagggaaagtattaatattacaggaagttaaatataagaattcaaggttgggtaagatgtagtcagcggtactatcaaagttaatagagagaaaactattgtgagaaagatccaggtaatttagatttttgaactttgaaaattgatgaaagttcagatgaccactcaagtcaattgaccccgtgaggcggttgtttctaagatccaatattaacaaggaagacaaagaataacaccaaggtggaattggtccctctaatttattgtcgtttaaatataaatgggagagttgagttagattaaacagtgatgagggaagcagtccatcaaaattgcaaccccacagacatactatgttaagagatttcaaatggccaatggaatcgggaatgcttcccgagaaagcagtatcagagagatacaagtaccttagtggagtactccagttagactttggaagttcacctccgaggtctttattatgatccaaatatagtttttgaagcttgggtaaagagaggatgtcactggatagattcccttgcaatttggtgtcagagagactaagggagatcaaagaggaagagagattggttagcaatgacaaagagctctctccgatacaagacatgtccacgccatctaaattaagctctcttaaattggttgcgttttgaatgagtttcttccaagtgtatggatcaagtctcattctcgggtagttgggatcataatttatcaaggagaagctaccgagatcaagtgacagtaatttggacaagtgagagattgtggagggaatgtgaccagtgaatccagagtatgacaaatttagatgcatgagattcacgagatcaccaattgcagaatatattgaagagccagaaaaattattataggctaggttgagtcgttgaaggtgtcttaggctgaagatggtgctgttgggatggagttgaccttgaatattactacagttaaggtcaagaccaatcacgtggcctgagatgatgtcgcaagtgaccccatcccactcacaacaatctgttccgtttttccaagattctgtctttgaagaaaaagaggaacaataataatgatatgtagtattgagagcatatgagtttttgaaaagtagcaaggcagaggtgtcaaggtggttgcagaaagaggaagaagaaggaagaaaaagaagaagaaggaagataaagtatgggagtagacgccaccaaacattgttagtcatattcatcctttcaactcaataacataactatagaggatttttggatacaaccatttcaattcacaaacttctatttatagcctacgctgcttcaaagcctttcatttcgattcaactctttctttgctttttcttccttagcctgtgtttcatatcatatcatgtctacctttataaaggcgcacataatttttcctttatctcattatttttacctttatttattttttctctttttatcaaatcatttattatatctattattttatttttattcaattaagaaatattttcactttttttaatatttaatgaatgtttaattttactcaattgctattaatataataatatatttctaaatcattatcaaaataattttctgttatttagataatttttttatattgccaaccattaaaaagtttaaatatttataattttgctactaattgattattgtaacaatgttaaaattaattatagtttatattttttacttcatttatagtgtttttggttaagtaaaatgttaagcaaatcactctccagtgggtgatccccatcaaacacccatgacatggattaaaaaaatattattttattattaaacaattttaacaaaataaaaaataaaaacaaaaagaaatttgttaaatcaaataaaaaagaatgaaattagggaaaaggaaaaaagaagacccaattattgtggctcatgcacaaaatcaccgcatctccttcacacctttgtgaaggtgaatttttctactttgaatattggagggacaacttcctcaacacattcctcgttaaagttgtttaatgagagtgagttggttgagattgttggtgtgaagctgttgtttaatgagaatatgtttattccatgattcacaatttcatagttttcttcataattttgggatttgaagtatttactcaaaaattatcatgcctaaaaacactctcatttaatagaagaattcgaattataatacaaaaatagattaattatagagttgtaaattgattattaaacataactataacaaataattaaaaggttactaaaactttcttctattttttttttttacttttgcaaagagaaatatttaaatttatttcttcaaaattttatttgttataacactagttttttttctttcaaaaaatcagttaaaaattctctcttaagatttcttagtcaccatcttagttctccaattattttatgactatattaatattataaaagtatagtctatcatccggaagaaaaaaaatgtctagtatcaagttaattaattcctcaattttttcttttattattattattattatagaatttctatggtacctctataaagttaaggaattttggtagtaaaacaagatattaagttagacttttaattatttatttgtttgtttattatatctctatatagtcctgtcattgtaggctcaactttgaaacggaactagctaaaaagaaagttaaaaagaaatgagcactcaatatcacatccaagacgaagaggctatagtgataaagtaaacagcgttttatgtagtaggagacgtgagaatgcattattagttacttttaatttttgtttcagatatacaagatgcttcatacaactttaattctaaagttagaagaacattaaatcatgaataatgataacaattgaaagtctaaccgcgtaaattgtcgttcgtggatgttgtgtccggcgttttttctttaagcgtttgttccttcgtgtgtgttggggagtagaaacttaacctgttctttcaccacaacacaccaagatttaatatattattaatttttttagtttaaattttaataaatatatatatgttagtaaaaattttaagaaatatttaaatatatttttatatacatacatgtttcaaaaaatgttattatttggagcattattttagattaaatctttggttactataatgatatcttacatgtcttctttttatctttttttttaaatgatttaatttttttaatgatttacatgcttgatttcggataataaaaattgagtgaaattttttaattacaatataattcttttatatttaatttatctttttaagtttcaaacatcatcaaaaaaatgattttacagtaaaaaaatgttattaaaaaatgccatttgattttgattggaagggaaggaaaaaataaaatatattaatgttaattatttgaattgatacttcataatttgattgattttaaattaaattattttaaaatttaatttcatatatatttgcattatgatatctttcctttgaaattgaattatttccaaaaatatattaagtcattttccacataaattttgtttttagttttattatgattaattctattttaaattaaattagtttcaaaaataatttgtttattaaatattttcatgaataaatgttataagaaatgaaactttattaaaataaataaatatttttgtgattaaaattcaatcaaatattcacataggaatatttttcatcaatcatacaatcttgtataatttttatttgcaaggtttacattttagtatagtaaaaaatgttattaaataattttgtataattattttataacaatcgttatcatggataccataatttgtcatgctattgtcgaactaaaatatatataaaataaaaattatataaaaaaattaaaattaaatagtaagtgcaaatatttaatcgcaaaatatttttttaatttgccttgaaagaaatatattataattaaggtaactatttaaaagataactactattaatgaataaataataaaaatgatatcaattgtatttattattaaatttattattttggaggaaatgaatatggaactgtcatgtgacattctctcatattatatagtagattgtattagttttttaaaaaaacataagttatcaaatcattctcttaaaaaaaattagtcactatttcagttctagaatgattttattactaaattagttctaattaaatctattatcaaattaatttctactacttttttgtaattacttttctgatttatcttatcattttcctatttcaaatttaagtcttgacctcgtcaaagacttgtaaaaatttcctaaaagaaatcctcgtaaactgatcgtctttctaactgcacacagtcgagtttgtatttgatggctgcagatttaaatatagtatttattaattttctttacaaaacatcatctataatattttcaaatacaaataattcgaatctaatctgacttagggtaataaactttaatgatttctgttattgataaacaccagcttatagtttatagaattggggtttagagcacttctttcatgaagagtgcacaagcactctcaaaactagtgtgtaacctggtgacattttggtaaatatgatacgcctatcatatagacactactctgcaaaacaaaaaactggagccagttgcttctttcgtccttcgatttctttcataaaatgattggtggtttgttacacacatccacgagattaaaaacatgttatactattcacttgatattcataatggtttctattttaaattttaatccatatacaaaatgttgcaagttttgtagaaattttacagtcacaaaatgttatcttttgttggcaataggaaccaagacttaacatacataaaacttatagtcttctagtgtaaagactaaacttaaaatgaaagacaactatatagaccaaatacatagtttaacttcgaaaatattagactgaacaaattgattcggagagtaatgagcatatctaaagaataagctcgtcatcaaacataaatgactatctatcaccaggggagcttcccgtattactaccatagcctctcgtgcaaatgctttcgtctattagtttcatagaactcagaagaaagaatcattgagcccactcctgcatggctgcattctatcaagacaatagcatcctgaatctgtttaaatcgatggttgaatgtcaatactgagttatcaaatgcacatcatatagaattcttgtagaaacaccacctgtaaaattgtaaaaacaattcttggaaagaaacactatcagtttcagaatcgtaccaattgaaatgtagagtggtgtagtctgatctgatcactacctacagaaactaatcatatcataatacgtaaagagagtggtcaggtcagtttacctgcttgaaactaaaatatcgtatacatcaattttgaaaagaaaaaaaaaggattgtcaattggtgcatataagcaaacattagactgcctcagtcactatgctttcagctttccgctaatcccacgtttgggccaaatacaagggacagaattcttcttcgctgcaactgaacactgatcactccgaccacttttattgctcagctctgtctggagtttccgtcgcctcattctgttctctaatcgtattcctcttaatgcacgggctctccgttcaatttccaaagcttccgtgaaattccagatcctgacaacaccttcttcacctccacagacaattcgttcagctcctatatccacagagaaaagattgctcttaaacccatgcaacatcctctgtggaggctctactatgtctccacccaaattctttccctttgaaactctcttccccagagctcgcttgctaatcctcaacagctttctcacatcaattagagccagcttgccatcacttgatgcggaaacaagccatggaaactcaaaggcaagggaatacacagcagccgagtgaggaacccatgcagcaacatgccaagttttagactcatagccaaccctaacaatctcatacatgtgaattgcaccatcttcacctccagtaaaaaggaagtcccctgtatggctccgtgccaaagcataagtattaccaacattaacattatgaacaatggtcaccaaagtcccactattagtatcccaaacatacacatccgaacctgatgtgctggcaacagtagtatcatgagggacaagtgcccagacccaatcactgtgcctcaacactgcagtacacttcattgaatgacggtcccacactctaacagtcgtgtcccatgaaccactgtaaatccttgtcaagtctaaagcaagtgaagttataggaccttcatgtccccagagtcgaacctcagtattctggttttgtgtggctctaagttcaaacaagtgaggcaggtcttcaacagccctccaacaatgaatgaatccatcagtaccgccagcaaccaatagttttctatctgctgcaacggcacgaatggtgcagccaaggggtcgtgatgatgcaattgacaacccattctccatgtcccacatcctcacaacagagtcatacccagaggtaaatatgaccttcgcagaagccaataggaaaacagtccgaaccgcttcagtatgtccatacaacacatcaatactataacgtcccataaaagtcttactcctaaactccctttccacgaaaagttccctccatgacttatcatcatacacaacacctgaatccacagccaaggaagctgccggaagcccccacctttcacagtagaattgcttccaagcatggtgctcggacgcaactctttggaaaattgtggagacacacgaaacaacaccaagatccttgggatcaaggcaattgagaatctcagatatcaatgccggatgaaggtcggtgatggacaaaccacaattgaaaaccacatcaccaggaattgaggagtagttcaaagcactgacaggggctttgatgcctttcttggaattaatcttggatgctccctttaacttcacacccttcccagattcaggtttggtagcaggcataaattttgaggttgctattccttcagtgaaggatttgggacaaagctggagattagattcaactatgcctatgcctggatttgctattaagtgtgctaaactttgataaacctcagtaccattcgggcactcaaatgccataaaaaatgaggatcctactctatgaatcaaaagggttgaaagctcaaaccacagaacgtaacaaattcaaaattcccaaacagaagccgagaaaaataacgaatcgggaaacctgaagttaaccctaagctaagcaacaatcgatatccaaattaagggtggaggaatcctaaaattactaatggaattagtgaaaaataagaatgattgaagtttgatgtgatcaaaagggaaaaaaagaaaaacctaaaggatctaattaagaggaggaaaatagaggggaaaggaatgggagagagatcgtaaaataccttgagaagagtgatgaagcgaagcgggagcagagagattggggtaagaaaatgcaattagggtttgtgttgtgtggttatgtctgcgacgacaaagaaagaatgagtatgagattgagaaaggaatatgccaacgaccttctggctaccttttccaggacaactcaagaaaaaatatttaaaaaaaaacaaatactatcaaattaatcatctaaaaaacaatattaaattaatattatatcaaaaaattaatttatcaacaaattattttataatatcattgtggttttcatagtgacattttagattttgaagaattagtattttaaaatagtaaattagtaagaaaaacttttaaatcttaatataatgatgattaaaattactatattgttttttcttacttctttatttaagaacactttttttcatttctaacttacaaaaatgaacacatgtcaacattatgcacacatttcttcgataacacttcaaatttgaggagctcaaattatatttaattcttatatatacatctgttattgatcattttatttattaatataatgtgaagccaaggtaactttttattgaatgtctatcaaaaacattttgcactaatagtattagctagtagcacttagatttattttgaattttggcacaaataaaaaaataagatttaattacttagtctttaaatttaaaatatatttttttagtttctgaaatttaaaaatactttttttagtccttcaattttaagtacatgaaatttttagtattttctgataaataccaatttaagcaattaaaaaataaaaattaatttaagataactaaaaattataaaaaatgtaaatttattaagttaggactaaaatatgcaaattttcaaattatagggaccaaaaatatattttaaaattacaggactaaaaaaaaattcaaaatttaggaactaaagcaataattaaataaaaaaattctaaataaatcataacataaagctttttttctatcagatatcataacataaagttaactatatatatatatatatatatatatatatatatatatatacttttttatgcatgagttaactatactttgaaaaacgctgtcctttaaaaaaagttttggaatccttaaattttatttacaatatataaattataatttatattatccagttcatcgtgcatatattaattttttgttcgtatcgaaaataatcataagatcgagatttataaacacatatacactgctcaagggttaaatctttgtgattatccatctatttattctaaataatacaatttattaattaattagtatctttgacttattttttataccaatgaacaactgaacatgttcccaattaatatgatgatcttaagagcacactgtgtatctcatgattttgtatttaaagtaaacaatattgtactccacctcttactcagaattagtgatcatcagtctaatctctgggtattaatgaattataataaccaatcactactgcacgcatataacgcatatatgagctcagaaatattgttgatacagacgaaagaatgaataaattttcccatcttgatctgaatttcgatatgcatatgcaataatttagaaatattgtattcatatatacgatccaattttataacagttttatgtatcttattggacttttttttcctctcgtattattctttggttcgagttttccaatatattttttctctcacaaaaaacaaaaaactaccactgagttatgattagcatttgcagcagcgaaatataatatcctattttggctccatcagttacgtacgcatagacaaaaactcatgtatctgtgtaagagaaaagagagagagaagaaaaaacgtacctactctcaatctctcaaacacacacaatgtccggcgacgaagccaccgccacaccgcaaaatcccaggttagcataacagggacgtggagctttttaacgcggcgagtgagtcatgcaggtgtttgtttgcgaggagcatgcatgacgttaacgccaaggctattttgccaaatcaggagtctcttgaggctttccaaaagtgttatgtgtaagggcaaaaggaggagagggatgaggagtagggaaacgaagaagaaaagaatttgtcaaattattcatattctcatgaattgatccttctaaatatttacaaaatcctaattttgaatttaaataaataacaactcatcctaattttgaattcagataacataatgaaaatttaagcaatgattatcaaatcaactgatttgagattaatggatataatctataagatgtattggactcttcatgatacacataggcttttgggtaacaatctggtccgctatattatgcaaaagaatagcgaggttgatcgtacagaactccccttcactcatcatgttatttctctttaagctgctgcttcttttcttctcatcctttggttttgtcattcttgacttgggtactttaatttcattccattgccatatgttgagctacatcatttaacctaatagtaataccttgtaacattcttttaagaacataggacaatgtttatttttattaagagagttaactaactataagcacttaggcgtgatcctgtgcatacaagagacacgccacttgtgtcagccatctaggatcaaaagcaacactttgggtagatggtgcgatcaccaaaccatgcatgcttatttttctactgtcacagcaatgcaacactttgttgttgcttctctaatttcaattattcaccatgacttttggatttagaatcgattttgtttgatatccaaagatgcaccaagggaatgtaggaatagcttccaagatagagcgatatcataggaacctgaatagtatcttgtaacattcttttaagaacgtacgacaatctttttttaacttaatttgctttcatcacatgctctgtttaatttaggaaagagtaaattatgaatgtccttatccaattttgaagaggaggaaagagataggtagtaaaacagagaatagaagcaatgatatatcttgaaaaaggaaagacagatataggaagaaaatgagggtcaaactagaaaattaggatcaaagagagagaatagatgtacgaatataaattacttttattttatcatatatatttttccttttcatcatgtttatttaatggttatttaatggaaataataataatgactatcattattatataatatttttttaacaatttttataaataaaattagataaaatagggaaatgtgtgagattataggatgagtaataagattgaggtggtagagcgaaaataacgttaccttttattacgtatatatattaattagtggaagaataatatttctaatttaatttctcaccccaaaaaactaatatttctaattacgatatttttgtgaatatgaattctgctaatgtaatattataccttaaaataaacgtcttattaaggtgctttgacttaattgatcttagccattattttaaaatatttttaaaaaaatttatgagtgagaaactaaaaaggttataaaaataaaattaaaaggataaaaactcaaactttaaaaaaggataaaatttgttcttaagaagtgatgattggtatcatattctttgggataactgggaactaaaattgttatttaagaatttatggatatagttaaaaatatgtttgattacattttaatattttttgggacaattttttataaataaaaaatgaaataaaaataagtcaaaatgaaagttacaaatattatttttttcatcccttatcatgagaataattaaaatctacctaaaacttgaatataatataacttttcatgaaataaaagatatcctacaatcttttttatgaccttctaattaaagaataaatattttgctttcgtattttcagaaatagaaagaaaatgacattaaacaaatgtctcattatataataaatataaacatcattcttgaataagagcgttttataaaagagttattattttatgaggataattttaagaaatatttaagagagagttaattattaaaaatgaaagtgtttttgttgaattagagtgtttttgtaacttgtctcacttggactttcatctcaagataattaatgtcacgacctcacaaacaatctctttttcaataattattccgcggaaaatcaattgttggaccgagcgtttattattaagccaaaagttatagatgataattaggacataactttttgacttaacccatctaaactttccgttacgaaacaattaatgctacaatacacaaaggatttttaggagttattattttttgaacaagaatatttttaaaagttattctaacttttattgagtcacgagtcttatcctaaatctatatattgagtatttaaaatggtgtattacatttcgaggctaaattagtcttttacctatttaattttaatttaatgatgaaagagattataataatataatataactagattagatatacatttatattagttttatttaatttttaaaaataataataaggtatttttttcaacaataataaaaagataattaaaaatagaaaattagacatgtaaaaaaacatattaaaaaaaaaagagagaagtggaaagtgaaaaatgtgaaataataaaatataatcataaacaaaatgtacggtgtatatgcgattgtggaacccacagcgatggatggatgatgcacagtgcacgtgagaaatcccaccacaaaagacagaaaaacgaaggaagttcccattaaaatagatttcgatctaagcgaatcataaccgtaagatattgatcaaacggtaaggatgacgtgtgtactcatatctaacctatgcagcactacatccactcactctcacgccacgctccttcctccctgactctgcaaccgctcggagctgcggaaccctaactctctctcattccctcaccgttcacgcgtttctgcgattcctcaacccccgatttggaacactctaattatttcacgagctttattaacaccacacttagttttcatcgctgtaagttatgacttccaatttttcgtttaatttttacactgaattttgttaccgttactgtttttattgttttcttttaacttttgtgaattttacttaaatttttgtaacttctattggctacttcatctctaggtatgcgttttgacctatttatgataatcaatggtgataattaattgaatattaaaattgtgtgttgtagctatgctgttatggtgtttagcttaaacctatttgacattgaacttttattccgttagcattgttcttggctatgtcaaatttctgatgatgcctgtcagttttgaattgttattgtacatgggacagatttatttttgtgtcacaccttaatttggtaaataacaattgtcttttaatctgaagaagctcacttttttttttctttttcttttttattggttcagtctttgttttgctacattctattattaataatatttgacgtttacttggtgtataggcaatttaagacaacccatctatctatattataggattaaagcatgcaaccctggctacatacaagtgataagcatgggagaaggaagtgaccgtcaagctatggcagacaatggaaatgctgaatctagtgaaggtggagttagtagtgctgaaaacaactctggttctcatgttcgggttggggtttctgagccatatgtgggtagggaatttgattctgaagatgctgcaaagactttctacaatgagtatggaaaacgagtgggtttcagctgcaaagctggcccgcatggtcgttctacagctgatggggcaaatatgtaccgggactttctgtgtggcagggaagattcgaaaagaaagcctcctgaaagctgcaatgcaatgattagaatcgagctgaagggtcaaaataagtgggttgttacaaaatttataaaggagcatagccattccatggctagcattagtaaggtgcataatattcggccacgtaagcccttttctagtgttggaaaaaccatgcctgaaacttaccaaggagtggggcttgttccaagtggtatgatgtatgtacctatggataagaattgcattcccactaaaaatattcatggaattaagaagattcccgcagctgttgctgttgctgttgctgaaacaaatcagccggttaaaagtcatacaatgatgaattatgctgttaggccacctactcgaaagaggacattagggaaggatgctcacaacctgctggagtactttaagaaaatgcaagctgagaaccctggtttcttctatgcaatgcaacttgatgaagataatcatatgtctaatgtgttttgggcagatgcaagatcaaggactgcttacagtcattttggtgatgcaattactctggacacaacatacagaataaatcaatatggagtgccatttgctccattcactggtgtaaatcatcatggtcagatgattttgtttggttgtgcacttcttttggatgattctgaagcttcttttgtgtggctttttaagacatttctgacagcgatgaatgaatgttaccctgtctctatcactactgatcaagacagagccatacaggcagctgtttcacaagtttttcctcaaacacgccattgtataagcaaatggcaagtcttgcgagaaggccatgaaaagttggctcatgtatgcaacatgcatccaaattttcagattgaactttataattgtattaatcagacggaaaccattgaggagtttgattcatcttggaattttatcatcaataaatatgaactcacgaaaaatgattggcttcagtccttgtacagtgctcgtgctcaatgggttccagcatattttcgtgattcattttttgcagcaatatctcctaatcaaggatttgatggttcttttttttatggttttgtcaaccaccagacaacattaccactgttctttaggcagtatgaacaagcattggagtgctggtttgaaaaagaattagaatcagattatgagacaatttgtacctcccctgttctgaagacaccttccccgatggagaagcaggctgctaatctctatacgcggaaaatattttcaaagtttcaagaagagttagtggaaacttttgcttatactgccaacagaattgaagaagatggagaaaatagcatattcagggttgcaaaatttgaggatgaccaaaaggcgtatgttgtcacattaaacctttctgagttgagagctaactgtagttgccaaatgtttgagtattcaggcattctatgtagacatgttcttactgtttttactgtgactaatgtacttacattaccatctcattacattttaaaacggtggacaagaaatgcaaaaagcagtgctggatcagttgaacttgctgatgaatcacatggacccgagtctttgacatcacgatatagtaacctttgttgggaagccatcaaatatgctgaagaaggggcattgacagtggaaacttatgatactgcaattagtgctcttagagaaagtggaaagaagatttctttcatgaggagaagtgttgccaaagttgcccctcccagtcatccagtcagtgggactgcttttgatgacagaaaatcccctacttcaacagcagatacaaaccctctgttgtggcctttgcaggacgaaataacacagaggtttaatcttaatgatgctagtactcctgttcaatcagttgctgatctaaatttaccacaaatgaccccagtgtctctccagcgagatgatggtccacctgaaatggtatgtgaaggagaacctcttttcttctgtttatttgatatattcttaggattggaattggactgcatggcattaaactgttccttgtgctttatcatgtaggtggtttatccgtgtctgaaatcattgacgtgggtaatggagaacaagaactcaacaccagggaatagagtagctgttatcagtcttaaggtgtgctgataataatatgaacgatgaaaaatttgtagtagtactcatgagtcatgatttagtttagagctggtttatatacctaagcttttgcatgagaagtttgagactcaaacaacctttgcccctttttgggtataaatatcttctgtaacatttaattgtggcagggtgtcctgctttcatcctcttgcaatattttaacaaataacaacgatgtgaggatcctaagtcctttaaacatattttgaatgcagttgcaagattatagcaggattccttcaacagaatcggaggttaagtttaatctctcaaaagttaccttggaaccattgtttaaccatatggtcaacatcagtgatcagctttccataccaactaggaagtttgctgtattgaatctcaaggtgtgtgattttgttccttatagatttatctttctcagccgtatgctttgttgctttagtagtctagtactagaaaagcagggattgatgctgctttgcactttcatgattaaaattccttaaagcacttctcttcttactgaatggctgtaaatgagggtgagccctggcacaacggtaaagttgtgcattagtgacttgttggttatgggtttgaatccggaaacagtctctttgcatatgtaagggtaagactgcgtaatatccctcctccttaccttcgcatagcgaggagcctttgggcaatagggaacttattttttttttttttttaattttatatttataaggtaaggttttgtgtaaggagtacatactattgattggattactaaggaagagaattttaattttatttaaattggcaacaaatgaaagggaacagaactagtctgtctgttgtttttcagggatggtggtattggtcaataagattgattattggggaaattgttaagtatgatcacattcatattggctattaatgaatgtatcaaacatgatgtggttgaaaatgtagctttataaaatgacatgatgctgttgaggcagataacttgtaatatcatggtatgacgttatacttgattttttactttaatatctttaaattggcctaaccaaattcagtttaaaatataaagaacattcatagggataaatacttagcctcattcatagggataaattggaggccattttttgatgaaaggagcacatatgtggagtaatgattgtgttcaatgtggatatgtctagcatttttatttgattagggtgaaatcattgtggaaatgatgtaagatctgttcattgataggtcatatatatgtccatataaaaaagtgtgcatttgtttttttctttatttttttcctcaatggcttgtgtctcccccttcccaaaaagaataaaaggaaagataaagagaacgaaagccaaaaaaagaatgtcatcaattgtattatttcttactgtatgggggattgagtgcatgtttgttacttgttattgtatggaaatctcaccttaaaatgttttctttgatttttggtctatgtacttcgacaaacttttagattgttgaaattctttaaactttttcagcttccagtcgcggagactacttctggtgcaagtgaagttaagtttcaggtgaccaaggacacactgggtgctgtactacgatcaatggcctatatccgtgagcaactcttgggtcctgtaagttgtttcctgttacctttttctttttatacaatgttttctgttacctaaataagtgccaccaggcgaatcaatgtgttaatttttcttttcgtgttctcaaatagttttttcgcctttattttcttctgaaaaatatttcgtgcatgttactttgtaaaataattttgaaaaaaaaaaaataagagaacacaatcaagcacacccgtaataatgcccgataaaatctctgtttatttcagtgtcttttcttgtatattacaattacaatttgagaacactttgcatacatattcattttcttgttataatttactttagtttaacctaaaacctcatatttgacagggtgatgtacagacagaacctatgtcaaaaaggcctcgtaagtgaagcggcaaatttttgtttcataccaagatggcttcgtgatggccaagtggtgaccactgaatacacaaatggcttagaaaacgtagtgaagtcttttttttttttttttttttttttttttaaaaagtttgttgtctaaaatatttgtgtagatgtatcatatcataggcaacagatttactttataggaaccgtttggaaaatcctttccagtcaccggggtggaggagcattctccgaacgaataacgagtagaaatgggtttaggaatttgggagaaaaaatggcaaacaaaagcaggtattttttagtgacaaaattataatttttttttttttttgtaagtttgttgtctaaattattttttagaaatcatatcttagtttggtggcaaaattaccttatgaatagtaactattcacaaaaaaaatcattttagtatatattaaaaaacattggatgtaaaagtgtaaacagcctttcaaaaaaattaaattataaacgggatagtcattatttcgatgcggttggcatgctctggaagatatatgaagtgtaattcaaataccaaactggaattaatgatgctatttgccaatacaaaatgaatttaaatataatggaggtgtaaataatttttacattgttattcaattataatttttaatatacagtaagattgttaacttttattataattattttaaaaattatacttaatataattttgattactgataaaaaaatagttttgattgattaatagaatgaaagttttacatttttcaatgaaaaacacgttttaatacagtttataccaattctaaacgcggcgaaacaggaaaacaggaataatggctgtaacttataataattgagtattgttgatgatataagcgaagtagtaggacgatatgtgcacttgcagagattgcgttatacacatatattaatggttttcatgagttatatcaatttatgattattatatactaaaaagttaacttatggagatcatatccattcacgttctatattgtttttgtttacaaatcatcatcaattaaaaaaagtgtacttttgatcttcacagtgacatgatcaaagtcaaatgttaaagattgctgagcagttcatgacaagtatgcttacacaagcaactttattatatcattcaaattccaaattccaaattctaaatgcaacatatcacaaagccttgggtgataaaatggttctaacaagatcatccattgctctaacagaagaccctttttctttacctttctctgttatggcttctctcaagtgagctgcaatttcattcgccttctccttcatctcctttcccttcccttcttgctcaataactatctctataaccttcttaacctgctccccagagatcacagtttccacagttcgagtgagctcaacagccacacccatttcctccaccaacatcttcacattgtatgcttgttctgcagctagtggccatccaatcataggaaccccatagctgagactctccaacacagagttccatccacaatggcttagaaaagctcctgtggaagtgtgtgaaagaatctccaactggggtccccatttgtgcaccaaaaggccacgtttggtgcctctcattctctcttcaaacccttttggcaaccattctgcaatgaactctccattgatgtcaaaaccaaaaggtggccttatgacccaaataaacgatcttccactctcttccaacccttcagccaaagccatcatttgagatgcactgatagtgttctgagacccaaatgaaatatagagaacagaattctcatctttcaaatccagccactccatacatgcttcaagggctatgccaggttcctttcctgcacgatgttttgaaccactgtgtgaagcaggtggcaagagaggccccacagtccaaacgggaagttgaagatagttcctgagaaggtgcaaccccagaggctcaatctcctcaaccgtgttgcaaatccacccatcagacttcatagaaagtgcagtctgtggaatgaagaactgtgaccactcatcagtgccatcagctgctcttagaaatttatgcaattgggtgcggtggaatttgtagttttgagggaaccccggaacatggaactcatcagaatctgtttttctgtgagggaggttggaccaaattgaaacataggccaaggttccataagcaccacaagtggtgaagcttaggttcctcatgcctaaactctttgcaacgttgttaacccagccaaggaacacgtcagatataacgcaaagtggagggtgaccctcttgttctgtgatctgtgatagcaaggagcgaagaggagcttcaaggctgagtgtcgaaagaaagagtttggctatgtgagtgagagggagcttctcggtgttctctatgttgggtggcaaaccgtgttgggtagagttgaagggtaactcagcaagatggatttcattaggagaagaaagtgcagatcggaggtattgaatgtttaggggtgtgttggctatggtgatggtgaagctttttgttctctgttggatttcccttgctagtgccaggaatgggatgatgtggccttgtgccataaagggtaccatcacgatgtgccccttcttctctgctgccattggagctagctcaatccttaaggtataaactcgtattcccttcacttggtttctgatataaaaaggatataaactataaacaaaggataaatacgtattttttgtccttgaagctgaaagtgccggaccatataaattaatcaaatgtataagaaattgtaaagttaatcatgtaaacaatttttaatctgttacattttttatatattttaattaaatttaatttttttatctatccagaaagcaggatcaatttatactttttaacactttcgggactaaaacgaaaacgagtatttattcaacttaaagcataagatgaagtagacatatggacctagcagtgagtgttcggcaaaaacgtgaaccactgcactccacgtactcactgcaatgtgcatgattgcatattataatttatatcttaccagcttttcggtgtcgtgggacatgcttaggaatatgttaggcctttcgtgaacgggaagtgtctttcgaacataggaaactgtaatgccaaggaaaaggaataccgaataagttattatacatcctgtcatagaaaataatcttaaatatcaagatgggatatgaaaaaaaaaaattataaatattaattatttgcttaaaaagtataaatgtatatatgtgattactctaatgagaatattcaatgttttttttcttcttttaagagtttttattttaagagatgttttttaaatgctttataaaaaagttgcaggaaatcaaaattagtacgtgcggtacaatattaagaatatgcagagtatcaatttttagatgtttgggaatctagtctatgtttggatttgagtttatccaagattacacacgcatgtttaattagctttagcaatataattagaacttttatcaactatgaaatgtattaccttgggaaataattagttgtactgttacttagtaatgtatgaataagtgattataacaatgaattaaattgtaataaaaacaagtaatgtgctacaggtattatattgaactagttgaaattgttgggtagacgtataatgtactcatcaagacagaaaattatgtagccaacagccaaacaagctaaccttaaccttgtgtgactaaggctccacaagacatttaaggttacttttagtttttttattagttcaaaaatttatttgattattcagttaataatttttaatagtttttattgttttttgaaatattaacttttagtttttttatttgttttttttcaatttatatcttcaatatatttatctaattttctaattatcatttttaaataaattatgattttattatttttctgttattttacactatccattacgtcttcaattaatttcatcgagtatatataatttaataaaataacattttaagtttccactaccaattaccaactaattttattcaacataacctacaccttatgattttcaatctctttcaatgacattggagtttttggctggacaggtttttaacttttattttccttatttctctctccttcaaaccaaatagatagatagtgcggacgtttataacttttcttttccttccaaggtagtcaggtcccccagcaccgaaaagctagtttgatttgagtaaggatatacgaatatccttattattataaacacttctatgctattagatatatagacacctaaagagagagaaagagataagaagtgtaagaatactaaataatatgatttgataggggaaaaaatgtatcaaaatagatgtttatgatataagaagtaatatatgaacacctttttataataaacattaattccatcaatttcaacatacttatacttttttctctttatctttctaagtgttaattagcaacttattatatgtgaaaagactaacacgacttgcatgagtgctgaattgttatatcatcctactacttggtttatatcatcaaatattcgaatgtgctgaattattataaccacaatgttcctgttttcttgttccaccttcagaatttattgtcttatcactttcgcttctctctatttcaaatagaaagctgcacttcttgtttgcaatatgattttagtgcctatctaatctatctataatgttacatccaaggattggaagagattcccttttttttttactgttctcaaaagttattatcagagttataacagaagctaacctagagaagaccaagtaacaaactaatttgataaaacagaaaattgactaacgattgactgagttattggttaactctaataatgatattaatgtttattgagattgatgagggtatatgggcatgctttgagtccttattgttgttccatcattccggttaagagtggtcaatatatgaaggggtttgttgagttgtgagtgctaattctcttctgtaaaagctctgttcgcagctgacaaagagggacggaggctggttgaatgacatttgaatgattattgttgttggcataagatcaaatttcaagacaattaatatactggaacagttttttttttttggttattttaagaaacaaatcttatatgattattaaaaaatacttatttttaagttatttttttaaagtttaaacaaactcatcccaagatctaataccacaacttttcagttcttcatactttgtttatgcataatcatgttgaaggataaattgattgtcatcaaagacaaaatcatactttgctgctataaacttatgggatgctaatttatttgtcaaagttgatgacaaagttaaggtaaatatagatattaaaaattctgataattatttaaaaaattaataattagcaagtcatcctattggttaaccatcatatcttcgaaccattggatttgttaataatatatcagacggtacataaacgtctcacagggtgtgaaaccattggtttaaaattcttgatataatttgttaggtatattgggtcttatcggtattggacacacgtgttatctttcctttttgatgtaggcctaaacccttagccctgaggagaagaatagttgccccacacttaatgagtttgctctgcattgtcaaaaaattaaaagctaaaatggttctgtttcttttgggcttaaaccatagtgactcacattgcgtatttgaaattgggtgacctattcgtatggctctttacttttctaataaatttgaaatctccaaatgctttgtattcttctttttcggttctcccttttacttagaggactaagttttgtttcatggttcatgagttgtttgtttccttgtaccttctttctttttagaacaagtttggatttggcctgctcgctctataagtataggtgatttcgtctatctattggccatgtttagattttctctagaacaaggcgattctgtattctttttctatcttggttaacatcaaattgaaaccattaatactaattaatcctactatttataatatctaaattttatgaaattgaacattaataaaaataaaatcatataattcatattttaatatatttaaaaaaatatattatatgtcaatttttatatataaataattatcaaataattttttattaatataaaattttatagatatgatatacataaaaaaaaaacttttaattcaatgatgaattttgaaactatattacatattgataatttggttcttaaaatatgatatttgatgtcagtaatcataaaattatattatttattgacaaattagtatatgacatacatgatttatcataaatggttaaactaatttgttataatatttatttatttataaactaaattgattattttgaaaatgtgaacactaaattattggcacaaatacatagtttatggactaaataatttacgaaaaatatatttgtacattcatatgtcatttcacactaatagaatgaaaaaagagagaaaaatataaatatgatatatgatataatgtgacaagaagaaaaagataaaaataaataaaatgtattaattgaattttaaaataaataggtgttgaatggtcccggcacagaaagttggaaagttgaagcctaacaggctacgactctgtaccatgtcacgttacttcttcattcatctttttctcagtgctttattttgtgaaacagcaaccaagacaacaaccattttcttgtaccaaagccagcgcagggtgtagcccataccattccttgagctcgttcaaatgacggagacaccaaagaagaagaagaagaaggggcacgtggtgatggtacccttcatggcccaaggccacatcatcccgttcctggcactagcaaggcaaatccaacaaagcacaagcttcaccatcaccatagccaacacacccttcaacattcaatacctccgatctgcactttcttcttcaacttctcccaatcatcaaatccgtcttgctgagttacccttcaactccactctacacggtttgccacccaacatagacaacacagagaagcttcctctcactcaactaatgaaactctgtcatgcatcactcacccttgagcctccccttcgctccttgatatcacagatcacagaagaagagggtcaccctccactttgcacaatatctgacgtgttccttggctgggttaacaacgttgcaaagagtttaggtattaggaacctaagcttcaccacttgcggtgcttatggaaccttggcctatgtttctatctggtccaatctccctcacaggaaaactgactctgatgagttttgcgttccggggttccctcaaaactacaaattccaccgcacccaattgcataaatttctaagagcagctgatggcactgatgactggtcaagattcattgttccacagattcaactttctatgaagtctgatgggtggatttgcaacacggttgaggagattgagcctttcgggttgcacctactcacgaactatcttcaacttcctgtttgggctgtggggcctcttcttccacctgcttcactcatggattcaaaacatcgtgcaggaaaagaatctggcatagcccttcatgcatgcatgcagtggctggattcgaaggatgagagttctgttctctacatttcatttgggtcacagaacactatcagtgcatctcaaatgatggctttggctgaaggattggaagagagtggaagatcgtttatttgggtcataaggccaccttttggttttgacatcaatggagagttcattgcagaatggttgccaaaagggtttgaagagagaatgagaaacaccaaacgtggccttttggtgcacaaatggggaccccagttggagattctgtcacacacttccacaagagcgtttctaagccattgtggatggaactctgtgttggagagtctcagctatggggttcctatgattgggtggccactagctgcagaacaagcatacaatgtaaagatgttggtggaggaaatgggtgtggctgttgagcttactcgaactgtggaaactgtcatttctggggaacaggttaagaaggttatagagatagttatggagcaagaagggaagggaaaggagatgaaggagaaggcgactgagattgcagctcacatgaaagaggccaattcagagaaaggtaaagaaaaagggtcttctgtgagagcaatggatgatcttgttagaaccattttatcacccaaggctttgtgatttgttgcatttagaatttgaatgataataaggttgcttgtgtaagcatacttgttatgtactgcccagcaagctttagcacaagactttggtaatattgtcattatgaagataataagttaactcattttaatcaatgatttgagttcagcataagaggtgaatgaatatgatctcagcaagcacacgtatctatataaacttttaatatataataatcattaattatgaggatgaagttagtgtagcttaaattgtttaatgagtgagaaagaaagagatgaaagataagtaattaattaatgatgtagtgtaatataaagagagataaagagaaaaaagaattgtttattgagtgttttaaattttgttatcaaaatataatcactcaaatattaacattgacatgattgctgaattgttataggaaaatattttatgaattagatgccaagggagagacagaaaaaagaaagaaaagtataaatttaataagatttatgatctgataagatgagaaagataaaaaaaaaaaattaaataataatgaaatatttaaaataaatgatagttgatatatcattcctcattcttttatcatcctactacttcgcttatatcatcaaaagtgctgaatttttattgccagtgtgttcctgttttcttgttccctgttcagaattgttttactttcccttctcgatctctatatcaaatgcaaaatctgcacttcttgtttgcaatatccaatatgattatagtgtctatctaatctatccatatcttttaatctataatgttacatccaaggatggatgagatttactttcttactattctcgaagagagtgtacagaaagaatgaaaacatatttgtattattgattgatatagagatacaagagatagtgaaccatttatacaaggaatggaaccaaaagaggtataactagggggtcaaactttttataaaaaaaacttaatgaaaaatgttacatagacacgtattgtattatttaacatttaaggagatggaaaaaaataaaaaaaaagtaatataaatatgataggatttataatgtgataagaaaaaataaataaaaagaatgagaaatattaaaggaatatttaaaatgatgagatgtttaatactctttcacaagcatcttggatttgtaataagtgctattaaattgataaaagttaaggtagttattattacgtcgcgtgatgagaaatgataaattgtttttaaaaaaattatatataaacactcatgtgttatatgacaccttgagagacatcaaagaagaccaaaagaaatataaatataataaataacataacttaataggaagataaaaatagaaataaaataaaagtattaattaagtgtttggaatatgtgaatgtttaaatataagcccttaatgttttaaaaggtgaattttgcaattttcattgatcattgtttaacgcatggtatctgatattgtgcttcatagttgtattggagttgatgtaggctcataaggtttttgatctcggacatgtattaggtcttacaaattgaatattaggcttattggtattaggtcaacacattgtctttccatttaatgtgagtctaaacccatcgagagtgatccaaaatagtagctctgtttttactatgcgttgatatgttcattttttttttataaaagaaatctaacaaaaatgaaattattagattatgaaataggaatataaattttatggatacatcgacactctaattatagtaataataaagtaatcattgaaatcatgtcttaattgtctgtcaagttgttcctttgtttaaaaagtaaacttttcatggctgcatggaagaagcactttcaagcattcaagttctttgatactaaggccaccatgatggattattctgaaacgttaaaaggtttcctccttaagaggcaatttgaggcacattttttaaatatataattgaataataatataaaagaattacagtatatattttaaaaaagcagtatcattgaattacacgtacactttttgtgttcagaaaatatttcctattcaaggcaacacataataaaagtgcacataaaaattgaggtgaattgagacgaaaaagaagaaaacaatagaaaaagaagagaaaataataaatgaaataagacaataaataatgaagtaaaaagaaaataaaaaaatatacttttatctataagaattaaacttatttaccaaagaaatttacataaactcatatacgttactcaattaattgagataataaatgaattaattaagggcaatattttcttatgaactgtaggttaagaaaaaaaatgctttcaaaataaataaaaaattgagtgtgcataaatatctttgtctgagtcattatcttttaggctaaatcacatttttaatctcctatatttctaaatttaggattttagaccctcaagtaatagtaatatttgatttccatttggttttacaaattaactattttgattcatctgtgttggatattagttaataattctaataggagttaataactaaattatactatttttttattttttccacccaatccatcttcatgcatttttttccctgtagttcttctaacgtttatgacttttctttcccttcttgggtagtcaggtcccgcagcatcgaaaagctggtctggttgcataggtaattgagtgcattgattcagattgttttttttttttatttttttgtgccctttttgctttattttgcacccttcttatcagaaaccaaaacaagagtttcacgttacttcatcatctcaggctctttgctatttcttttgtacacttcttagcagaaaccaagacaacaagagttgagtttagtgttcttataccacagacagcgcagggtgtagctcaacattcctcgatcgagctcgctccaatggcagagacaccaaacaaaggccacatcgtgatggtacctctcatggcacaaggccacctcatcccatttctcgcactagcaagacaaatccaacaaaacacaagcttcaccatcaccatagccaacacaccccaaaacattcaacaccttcgatctgcactttcttcttctacttctcctaatcatcaaatccatcttgctgagttagtacccttcaactctacccaacactccaacatagacaacaacacacaaaaggctcctctcactgacctattgaaacttggctatgcatcactcacccttgagcctccttttcgctccttgatatcacagatcacacaagaagaaggacaccctccactttgcctaatatctgacatgttccttggttgggttaacaatgttgcaaagagcttaggcactaggaacctaaccttcaccacttgtggtgcttatggaatcttggcatatatctctatctggtccaacctccctcataggaaaattgattctgatgagttccatgttccgggtttccctcaaaactaccgtttccacagaactcaattgcataggtttcttcaagcagctgatggcactgatgattggtcaagattcctcgttccacagattcaactttctatgaagtctgatgggtggatttgcaatacgatggaaaagatagagcctttggggttaaagcttctgaggaactatcttcaacttcccgtttgggccgtggggcctctccttccacctgcttcactcatgggttcaaaacatcgttcaggaaaggaaactggcatagctcttgatgcatgcatggagtggctggattcaaaggatgagaattctgttctctatatttcatttgggtcactgaacactatcagtgcatctcaaatgatggctttggctgagggtttggaagagagtgggaaatcgtttatttgggttataaggccacctgttggttttgacatcaatggagagttaagggcagaatggttgccaaaagggtttgaagagagaatgagagacaccaaacgtggccttttggtgcacaaatggggaccccagttggagattctgtcacacacttccacaggagcttttctaagccattgtggatggaactctgtgttggagagtctcagctatggggtgcctctgattgggtggccaattgttgcagatcaaccttataatgtgaagatgttggtggaggaaatgggtgtggctgtggaacttactcgttctacggaaactgtggtttctagggagaaggttaagaagacaatagtaatagttatggattatgaagggaagggaaaggagatgaaggagaaggcaaatgagattgcagcttacattagagaggccaacacagagaaaggtaaagaaaaagggtcttctgtgagagcaatggatgagcttgttacaaccattttatcacccaaggctctgtgatttgttgcatttagaatttagaatttgaatgatataataaagttgcttgtgtaagcatacttgtcataaactgctcaccaatctttaacataagactgagtctttggcagtgtctgtatgaagatcatttccagaatttgcactgattatttaaagattcttatacttgatgttgctcaaacaaatttgtgtttaataaaaggtattgggtgatttggaacaagataataagtaggccaggggttatcataaattgatttggattggtttcagaacaaaagatcattcaatctaagcataaacgtaaattgtgattccgtttgatttgagtataatattaaatctaatttgattcaataaaaaaatcatttgcactcaattcatttatttatttattttaagacaacaaatgtcaaacaaacttggatacatgggaaaaggaaatggttatgaaaatactagtaaagtttttttgagaaatagttgaagaatttatcactacatcaattaaatttcatcattttttctataataatattactggatcatgtacattcaatgcatgcatgataattatttgtgttactagaaatctatacttctatggtaaagaatgatcacaacaaaagagaattttttattttgtattaagaagggaactaaagaatgttagatatacattttttaatgtatttttcattattaacaaaaaattattaaaaattacaaaaaactagtttccaaaaagtattaaaataaactaacagtgtaaaaagtttcttcatttttgaatgtattaaaactgtattcttcatttttgaatacattattaaaactgtattcttcatttttgaatgtattcttcatttttaattttcttctcatctctctttctttgtttaatcttgggcagaccatttgttttatccgtaaaaattaaaaatagtgtaaaaagtttataacactcacacaccttgtttaactaattaaattaaattccttaactctttctctccattttacaagcaatctaaacgatggaagaaacataaatttgatcttcttagttcttattgttttttcttgacataaacacagcttatggagtgaataccaattattttccttcgaattttcactggaccctttatcgtttctcaattcccttcctccgctgaccaaaagaaaacaacaagtcacgaagtcaatggttaattaggcaattgtaggtaaacaaaatgcatacaaaaacaataatttaattaggcagaagcctgtggactataataaagtaggtaatagttagtaaatgcacaaccatttcatcatccaagtatccaactactgttttgagacgcgctgccatgggccatactaaatataataaatttattttatgtttttttttctaacgcaacaaaaataataagatggaaagatcaaatctggatgaattgtaggttgttttgttacaagcaaatgcaagcttgcgctaaaaatattgaggtgtgtgtttgtcaaaattagttttgtattaagtagaactaatttttaaaaagcagtatcactattttgtacgaaatcatttagtaaaattacacaaagtgatgattcatggatgtctaaattatcatttgtgccttagtaaattatcacatcaaaatgtataaaaaataattaatagttgtttcggtaatgtacgtcaaagatgtataaatagatatccaaatacacaaaacatacaatttatcggttaaactttactcaccatacatggtgaaagaaagtagtgaaatatttatttttacaaaaactttgaaacaatgaaaaagagaccaaaatgtattatcaaaatattctaacgagaaaggggagaactatcaacaaggaagaggtaggatactaggatgtacaatttgtaagatctagtatggattttacatgttttatagttatactcaataattctcttagtatgtgtttaaattggtggtgaattgaatttaatataaattttagaagcaacaaataattacttttgtagtgaattcagtatgatttttcactcattatgattttacactccccaaaccaaatacactaggctttgagatacgagaaaaagaggatcaaggtaaccattgcaaagaactcgatgcactgtttctcttcaaccatttgagcaaaatgctataaaagaaatatgaatttattctgagcataaattaataaggttggacagtaaaggtaagaggaaacattaatctatctttttcatttttaggagaagtgtgaatttttaatgtttcactaataatattttattctgggcataaattaataaaaaaatattattatatttacatttttattccataaaaaaattacacttttttttaaagaaaaatcatttgttcacaaatacaaatatattttttcaaaataatttttttcaccatcaatttcaacaacacaaaaccaattggaaatttgttacaatatgtggtgagttatagattatcagccaaaacggttagctgtccaaccccaactgcatcacattaatgtatgcatatgcatggcttcatcttctcctgaccatacttcacattaatttatcttctcccatctaaaatctatatattatatattacatctgagtttcaattttcctaagctcacatttcctttgtgtttgtgagtaacttgcaaacacaccaacaccacctctctctgtccaattcaggtgattattcccctttcttcctccttacttcttttcctccaattgggtcattcatttctcagcaacgagcttttgttaagttttttatttttttgcctaattctgctgtgactcacattctctgttatcatcgaatcccgactttcttcgtcaaagttcgtatcttttgctaacttctccacactattactaaataaataaaaaagcttggaacttgaccattgttttgccataattattagaaattgaatgtggggttttctgctacattaacatgattgttaatttaatagctttgtgtaaaaaatcacactccttgcattgtgtttttggctgctgatgtgaatcttcgttttttctattttcagaccccctagttctgttggatcttgcatatagtaaccctttattgattcgcaaagatgaaggtcacagtggtttctcggagtggaagagaagtggttaaaggtggcattgagctcagcgattctgtatgtctttttttaccctctaaatattttactctcttttttgtgttaatttaattgttgtcatggtagttttggattttgatatctcgattgatttggagagttaggttttatctatatggcggaaaatttcccttcattttgtctatcttttcaattggcaaaaggggactttgttttcaagagtaataatttatggtttatccctttatttctttgcgtaggctactgtagcagatctgcaggaggcaattcataagcgaagtaagtgaacttattcattttctctactatgcttatgtataaattactttgtttttaaagtaatgtctgagatgtaaaataactgatatccagttagtcttgggcgtacaagggtactaaggtagttgtacatgtggttttagttgttttttacttgtgatggattttaacttattacactgagtgatatgataattgataacagctcctgatgttcatcgacgtttatcattcttactatgtagtatttattaagatccaagaatcccagatacataatatgatatggttatgatacagatacacatacaaaaattttatttttaaaaaaaaaaaaaaaacaagataggacaaaaccatgatacattaccaaaaatgcacaatagcaataacaacttggagaacacggaccagcacccagcgaaggagagagaaccaaaagaggagctagaaccaccagcaacttcagcaatgcagatggtttcttgcaggagattgttcatgagaaggaagatgcatttggttttggacttgctgtttgcaagccctagtggtgatgggggctcctttttgcaacacgatttggaacaacctacatgaaaagggaaatttaacaaaaaaatacactacatgtctatttgaaatgaaactgtattctgaggttctcagcagcatctttagccattttggtattgggtacatgttggacgccgatacatttgcttttttagagtatctgggcttcataaattaagatcctttaatgattatagcagcatgataacctagtagcattgagtctcagtattgtttattagattatagatccaagtctttgtcagtagctttatagttaaacctattctaggttgttgaagttgaatagaaatatttgaatgttcctcagcttatgaaaacataacccaattttaattgggtggtgaaataaaatgaaatattggtgatagcactagttcaatcctgcatgcaactcctgctactattgtatggctttgtctttccatcttagtacctctcttggaggaaaaaaaaaatgcttatctgtaagtgtatctgtgtctctaggcaccattggatttcatagatcattaacatgatttgtatgtttcacttacagccaagaagcacccatcaaggcagcgcttgacacttcctgtccaacccggatcaaaggaaaggcctgttgtccttaattacaaaaagagtctgaaagactatacaagtggaaattcagaaaccttaactgttgtattcaaggatttgggcccacaagtttcttaccgtacacttttcttctgcgagtatttgggaccttttcttctctatccagtcttctattatctccctgtctaccaatattttggctacaaaggtgaacgcgtcctccaccctgtgcagacatatgccttgtattactggtgtttccattatgccaaacgaattctggaaacattttttgtgcatcgcttcagccatgcaacctcacccctttccaatgtgtttcgtaactgtgcttattactggacctttggctcctatattgcttattatgtgaaccaccctttatatacccctgtaaacgaccttcaaatgaagattgggtttggaattgggatactttgtcaaatttcaaatttctattgccatattattctgaagaatcttcgtagtcctggtggtgaaggtggataccaaatcccaaggggctttctcttcaatattgttacctgtgcaaattatacaaccgagatctatcagtggttgggattcaacattgcaacgcaaactgttgcaggctatattttccttgtggttgctacttttatcatgaccaattgggctttagccaagcacaggcgtttaaagaaggtatgcctccttaccttttatatttcagctcactaatatggtttacagtcttagaaaaatatctaagagcaaattatatactccacctgaactttcttgtaaaggaataacttgattgtgctttttcctatactgtctggttttagattttgaggatttcaaaggtttgtggctaacttgattttcagactccatcatattgtttcttctgcttctatgttaaagttaaacatgtgaattcaaaaatgctgctccttgtaagaatataatgtttattgcttggttatgccaaggtcaactaaatatggattttgcatttttatttatttataaaattatcatttgtatggggtgaaaccatatcatatactataaagtgaaccaatattgttacagcatgtttggagacggatcaagcacgtggtttttcacatcaaaatgaatgctactatctttatgtttttcatattaaggacatgatttgttggttgtaaaacatgttcccaaacataatactagtctcttcccctttttgcatcttataatcatgaatcatgtgtcttatctttttcgatgaacctgcagttatttgatggaaaggaaggtagacctaggtatcctcgtcgatgggtaatattgcccccattcctgtagaagccaaagcaactgatgaggtcaccactctgctcacaggattctgagatttaaattgtagcataatggaattttcgtgatctctttttattagatatggatttgtcttgcaatgcttttgactatgaagtaaattgccaaattactgaatcagttttctgcagaatatttgtaatcatttcaagattgtagttctgaggattcttgtttcttcaaaatcttcatcttgttgctgtttaatttttgttagctatttccttttactgtctccaatgtttcattaatcattttagaaaattaaagttcaattttgtagctcatacactatgcaatggtgaggtttcaagagtcaaaaccactgatcttcctccacatttaggaacaaattttcgatgctcatgtagtacatactcctttggtagtttttatccttatttattagttttctcattttcaaaaaataaaaataaaaatacttgccaggtgtcataaatgtgaaggaagattcatacaaaaaaattcctcatttagggtgtctgatgcttattagtattttttttttttcatttgcacaatgaagtataaagtcgtgccttgataaatcctcttccgtagacgttgattgtttttcttagcccaaacctttgacccaacaaaaacctttactttttcgactgaatctatgactcgagtttatgtgcatttatatcttgtgtctattgtttttcttagcccaaacctttgacccaacaaaaacctttactttttcgactgaatctatgacacgagtttatgtgcatttatatcttgtgtctgctaatagcttcgttgtttgcaattcatacttaaagattgctaacattttggttctcgcatgtagtggggcgataattcattgtaatcatgaaatattttatctttaatttttatttgttgttttttttttatatattttgacaacacaattaggataagtaataatttagttcttgttttcttacaacatataactcagaagaaaatccgcgatggccaatttcttcacacccagggttaaatgatacaaatagcaaaatcataacaattccatctaagaattgatttattaccagtcttcagtgtgtacaactggaattactctctagagtttaaacctttatctatataagcttcatctatatctaaattgtgtactcaacaattttcttctattaagtctaatagatcatatacaatagcatttttgttttttgttattgaatcatatacattggaagaatgagattctagtgtgaagtttataagaccttgaactttcaactgcaataactagcttttgtggtatagttctctcaagatttttatcaaattttcaaaagatcctaacaattttttattttgttttatagcttctttaatttttagttttttttcattcaactaattttatagaaactgtcaaatagccaatgctatgctctaactgtctaaattaagagtcaattctgtctttcacttatagagaaggccttcctaggtaagcaaccgaccttcatttttcatgcaagagagtataacaggagtcaggagattagtttatgaaattataatcactagtcactttaatctctaaaattatttttttgggggggggggggggattagtccttgaaattagtaattgtcaatcattttagtctctaaaaataaagatatgcccatttgatttctaaatttcccaattatagtcattgtaattcctgatttttatgggcaatagtcaattcggttcctaataccagaggttaaatgaacttatgaattatgattgtcaaattcaagaaccaatcattaaattcaaggattaaatcaattgattctagcttatataaaaaaaaaacaattgattctatgatgtcagatcaaattaattgatagcgtcaattttaagaattaaattgattgacagttataaaagtcattaactaaaatttcttttttataaaatttttaagaattaaatgaacttaatttcaaggactaatctaaatctagtgctttaatcccatgattaatgaattagaacatgaatggtatctatgaagatatggtgtagacacgaggttatgaagctagaatagaattggcgttgttataaacttcaaggctgaactccttggattgtccatacataaagtattaatcctcagcctcaatcttttatcttacaaaacataacaattttccggtgaaataaaagtttaactatttattgttaatttatttttttaagtatatttatagtaagagtttaaactcatttcgatagtgtaaaattatattgacaatgtaaaataaatttaaattatcaatcaatcataaatcattattttaaaataattattttaaaaatgaacaaacttattgataaaaatttatgattaaatgactatttttttttaccgtgcataacctttttctcttataatcttatgttaatactatttttatcacggcatgaaccataaatccatatttgtgtgctccataatttattcaatttttttaacgtagcttggtaaatacaataatttgcccttacttttgagtgatagcaattacccactacggtaaacaactactcgaatatcaattttttagtagctcatatccgtacacatccccactgatgactagtagacggaaaaaaaaaaaaccctgaaataacatgtttatactatacgcataccaagtaataaataaataggtgaaaattgtagaacaagattccaaatttcacacgaactccagtcctccacagccatgcgatagttttaacccctcccaatgtataaaacgatcgtcagaaagacaatgcttgaaaattgctatctgcaaatcctaggttgatcagatgatgttcccagaatctccattacattttcatttcatgatttgtaggtccaaaaatcggtatgcttccagcaacaccaagtagaagaaacaagcatgcattggcctcacgaattaaaacagacactcaacccgtagaatgcacttcacatcatcttcgcattcctcgtccacgaccacggaatccacctccacgacctctgcccatggcacttgcagcagcatctccttgtgcactttcagactacagataaatagacaaaatcaaaatcagctgcataacggaagtagccagaataaaagaggatctggttacattcagaataaaagaggatctagttagtaggcataacatatttctgaaaatcaatgtaaaattcagatagtcacaagatagatccgggtagaacaattgcaacaataccaaaattgtccacaatctccctctctctctgtttgtccattgaataggttacaacttctaacttaaccatttatctcaagttcaagtatagcgaatgtagttgcattaaaactcaatggcactccatcgaactaaggtgggtcaaactttaaaaataataattattgacaggaaacaaggcaagggcacaaaatttttgtaaaactactaaaaaatttgggtacctcgtgttagaaaactttttttgtcattttgtaagagcataagcatttaagttaggaaaagaaacaaaaaatctctatcccataggtcccaccaataacagcattcccacatctccaagaaagagaatattgattcctgtctttaaagaattcagatgaggaatgaagcccttactgtctcttcccttagcaaaccatggaaaccccattcacatggagtaggaggaggataccattccaacacaatatgctaatcgatagagacccggataccattttcaaaacaagtacaacaaatttgcatgaaactagtactcattcctcaacgcacagtgataatatatgtacaatgcttaaaagagacaagcgtaaaacaattgagttgcaagaggatttgtgtagagaattcattatgtgctgctgctgcacatatcaaaaggtaaattataaagcattaccctttcaaaatacaaaatccctgaccaaacagagaaataactaacgtgaaattagaaaatacataatataatatgataataaaaatcaataattccttcaaattgtgcaaatctccaggaaataagttatgaacagaagcacaatcctcatctaatatacaataacagaactaaatttaccttgggatttttaattgtttcatccacacttaagataaggcaagcagcctctgttgcagcatttatagcattgatctgcaaaaatgttaactaacttaaacaccatgcacataaaacatcagaatcaggacatgatgcaaataaatgcaagcagataccttcacaagtgcaggctcccagacaaagttagcaaatgagtcagcaattccaccagttgctatgtccaccccatagggtgccccctcacctgtaacaagcagacaaatgagtatatgccagcatgcatgcaagtaatcataaaatacatctatgtaaacaagcacactgcatgcatacaaaaagatggccaaccaaccagaaggaagcgcatgtttctgccttagtttattcagcacatcagttgcgtcaaatccggcattgtcacataattgtctaggtataacctgcagtaataccataactttgcataaaaaaacaatcaagtatactgtgagtggaagaacatgattccatacccttcaggtctaatactctaatttcttacagtaccctaagtcttcatgcaagaccaaatacttagggatgcaatttcaaaacatctaatgtgaaaaagttatagccttctaaaagacgtcatttgataatcccatgctcacagacctccaacatccagtacagcaattaatgtctcaaatagtcaaatgcaatgagcacttctacttttacaatgttaaaataaaggaacatatcaatgtgtcaatttcaggttgaattgcgccatgtaaaatacatgcacaaaggatttttctcccaacccttccccaatagtaatacagtgaggaggcatatgattgaacagttcctcatcattggataaaatgtctgagaagtgatagccgcccttaagattttccaggattgctatgcattgttaaatatggatcgactaccagacacattattaatggcattaacgttggatttggaagaaacaacattaacgaaacacattgctaatagctaggaatcctattagtttaaacttaagaccattaagctgagaagttcttgatggagatcgtcgttactcgttagtgccaaaacaaaaccacttgtgtgtcaaacaggcattgcctcgagttactaacaaagttgaatgaataaaatactagaataacataaaaaggattgtgccaaattccaaaacagttacctcaagagcttttgcataggagttaatgaaaagctgagactttccagctattgtacgtgcatgctgcctcaggtaccggcttatctccatctaccaacaagaaccacattaacttccaacaagttgactaatataaatcagtgataactacctacaaattttagacacatacatctattgcacctcccccagcaaccactgttgaattcttcaaagccctcctaacaatcatgattgcatcatgcaaacttcgctctgcttcctctatgaactgtaagaaaatagtaaatatcaaatataagtccaagattaccagagctattacatgagttcaactacaagtttcataaacagttattgcacagcacataacagacctgatcagctccaccacgaagaactatggtggctgtttggccagatggacatccattgaaaatattgaacctctcatttccaacctgcctttcctcaaaaatttcacaagttccaaggaccttcaagcaaataaatcacaaaaagttcatctgtaatacataaaattacagaaaatgagcaaatcacgacagagttacacaagtaatgtgaaacctcatcaataatgttattcacagatgtttgtacggttccaccagaagcagcagcaaccctttttagatcttcttcagctacacgaccagcacagaaaatatctcgatctgcaaaatactgtttcaagggaaaattattttttttaaaaaaaactaattatagttgatatccctgaaagtttttaacatagtaaaaggagtaattttcaaccattatcatgaacaattaataagggtgtcaatctacacttaaacgtgtaaaacacaaacaggttgatgccgaatagaaaatgcaaaaatgaataaaagctcattattacataagagacaatgcataaaatgtaccaggaaaccatcctaggaggaggtggcacacagcacactttgcacttacttaaaagaaacgttggatattttataggtagttgaaagaaatccaagagtatgaaaaaaaatagatttaattaaaaaaaaatgattaaaacctgtgtagctagatcaccaatagccaatcgtgaaagaacaactttggcaccactgctgacacatttatccaacttgtcataaataatattccattctgcatcaactattgactgatattgcgcaggatctgataacctgtacagaacaagaaaaaaagaatgaattccaatttggtatgcaatccttcactaagatcccaggtcagcatcatcaaacaaaaaaaaaaaaaactaaaacaaaaataccttatttctgcattttctttctcagattttagctccaactcaacatttagtaatagtatttttggattgagaaacttcttgggctgttgctcaaacccagcatatgaaaatgtctttttgaaggcaacaccatttactagaaatgagtcccgcatggtaccaccaggaacctgtagaagaaaacctgagtctccacgattgattttcaaaagaattctaaacactaacacaaaattgattaacatgtaattaaacattaaccataaaaacaaaatcctgcatgacagtaacactccttgatcttcattcgtaaccattttggttagttgattgtttttactttctatcacatcatttgggcaatcaaatactaatgcacacatttaaaattccaaaaaaaacattattatagaacatggaaaacaaatataacacatctactttaccatatctgaagagaagtggaagcccaaaaaatctaattacaatactataaaaactaggcaggctttatttggggggagggaggcactaaatataaatgatgatgctttttactcattctcaaataattgtcactttagagtatagcacaagaattaaggaaactaataattatcccaaaatctagtgattattgaactaaattacccatttctcatgacaatgtattattaataattcatctattaaaaaaatcaacttaattttacaattatgaagaaaatatttaatgagcactattgttaatgtggaggacaatcaaacaatcaccaatgtaaaagagagaatgcaacacacaaatacaagattgcaaaagaaccaacacatgtaccttctttattccaatcatgttcaacctgtcttcattttcaattgaaattacagcatccacaaccatgggtgcaaagaattctttctctccacctataagcttcgaagaaagtgtggtagaagcacactttgcaagcaagcttttcttttcttccagactttttccctctatgctaacagctaaatctttaatcttctcaatagcctgcaccaatgataaaacaagacaaaagtaatgtgacaaatcaggaacatattccacttacagtattcaacagtaatttaagacaaaaataaaagaaaaattaaggccaggccctgcttaggtaaacttttccataagcacttataagagaaaataaaaaaggtaaaatgaatcgaacttctcccataagctaaaataaacttctgcacatcaacatctggagaagttagataagagaactttagcaaaagttaagtgcataagttaattttaacttaagagagaaactcaattcatttcagcttgttaacttattctcctataaatggttatatagaagtttattcaaacaaggcataaataaataaaattggagatagctctgtaccaaggagcaggccgtcctatagctccgtatcaagttttgagagtgaacaccatcttcaatgaatggcttggcctcccttaaaaactcagctgcaagcaacaccacagtggtggttccatcgccaacctttttcacattcacaacaatacaagagttcatttactaacaaaaaattccaattccaaagtttaaagcatctgaatgaaccgaaaatgaaaagatcttgagagaagtggcattgcaagagatcgaagggaagttaaagttacctcggagtcctgagacttggcgatgtcgacgaggatttttgcggcggggtggacgatgtcgaggagcttcatgatggtggcgccgtcgttggagatggtgacggttcccttgtcgtcgtggatgagcttgtccatgccgcgagggccgagggtggtgcggacgacgtcggccacggcggtgcaggcattaatgttgctcaccagctgtggcttcccttgcgaagtgtccgtgccttccttcagcagaatgatctgaggttgctgtttgatcccacaccatttccaatagcaacgagttaggttaggttaggttaggttatggaaacacgtaacagagcataaagagaatgaacttaccagcatcgctgacatggttgaagacgcagaagaaagagagagagagtagaactagggtttaagttttgaacttcgagaagcagcagttttctggctcctactctcgcagtgaacgtgagatttctagagctggtctctatttcgaaccgatatttcatttttatctacatttgggccttcagcccattctctatcccaccaaaaattttacaaccatgaccatttggtgtataaaggatttttacgtgctaaatcgtgtaaagaaatacattgctatttaatcagaaattgttatatacaattagtttaagtttgttgatttttcttaataattatataaaaaaatatattatctctgataatatgtttaattaaaagagtaatattgtgttgtgataaaaaaaaaaaaagtaatgatatatttgggcccatttacaaaggactgaaatacgttcaaagcaagtctcttcatcatctttaaaactcaacgtatgtatcgagactagacaatatatatatatatatatatatatatatatatatatataccacatgtattttttatagaaaataattcaatttgaatcaggataaaattactttaaataacaaaatttttcttatatccaatccttaaaaataaaatctcttacaaccatttttcaaacataaaataaataatttatgcacaaactcaataaagaattttaacattcaaaattagttaatataataatttaaaaatactagatagtattaattaatgcgtcttgctgacgaatgttcttacctttaggacactagttaaagaaattaaaaaatgaaagtttttattggaaatcatataaaaacgcatttaaaaactgtaggaaaacattttacatatttcaataaaatattttcctcttttatatgtctgacatgacacaaattataagaaaaaatgccttgtaaatagaaaaattaatagaaatacttcacacaaataatatattttttctgttcagttatcattaattgaaaatgtcaaaagacacctacaaactcaagatactgtgaaaggagcattgtgttacaacaatgcacaacaataaaacaggcacgcacgctcggccattagctacacatataaaaacattgctagagtcttagacatttctacatatttttctttgtagtcccttccagattacacttgtcaaccagtaatgaactaaagcaacacacagcaaatctaagtagaacaatgttatgtaaggacctcgtagaaaagcaacaaagctgactaaggtagtgttgcctaagtagtaaaaacctttggtggtttggcttcaattgccaaaaaaaagactcacaaagaagagagaggcataggaaaaatcacaaaaaaaaaaatgtttaatgtcacaaatgcatcatatatctatctttttatcgaacggtcttctattgtgtcgaagggttgtctgtttggtttttcctaccgaggtctcaagtgcttacgtgtctgaaaaaaagaggaaagagtacatgcaaaaaacactttgatgctcaagtgaaggtttgatctagagctattaaggatatgtagtgagtagatgagaatgaatcagtcttcttacctgaggggttcacgcctttttatactaatcttgtaagacctaagatgtgtgtttgtcacatcatgattaccaattaagtaatattccttcttatcatgcttagacacttccaatcaagttatcatccttaaatgggtttagtggaaataatcacagtcaagtggtacttattgcttgtacatgttgaaggtcgatacagtaaatacatactgttcgacataatggatacacgtagtcaaggggtgtgtttgatttggatgggccaggtgttccctcggcttggtcgggcactttatccggtataaaaaaatatagaaaaagggatgaagatggtagctaaaaatggaggaaggaaagtgggtgaaggcaatggtaaaaagaagtaaggttgtggttgtgaggtagaaaagggaaggtggaagaagaagaaaaaaaactctcactatggagagaaaggaatccatctaaaatgggaagaaaattctcccattgaggggatggccccccaagggggagcactctgccaggtcccgtttcttccatcaccatgtttatgaggttaactttatagttcacacaatacttaacatgttgggcttgaagtaatgagtcaatctaatatgttaaatgtcgcgtgaagtcaattttatcgtcctgttattttttctccttaatttatgaaaataaagattactatagcatttttttataaacgatagatcaaaataagttaattaatttatgaaaataaagattactgtagcatcttttataaacgatagatcaaaacaagttaatttaatttcaagtgactaaaagtaaacagtatcctatttacatgaattgaaaacatatacaatcatttaaagtgtaaaactcattgaaacaaaactctttttcatatatacagttaggaaccgaatagcatgacaaaaaaaaaacataattatctactaactattttaaaattttagaagttcatcctataacatagataagcgaacatcaaatgattgagtgatgatccttatgcttgaataccaaagaagcattgccaatgaaatacctcaaaacaccaatgctaaacatctatcttagtttgaacagaaaatgaaaatggcaaaaatctctggtctctatagtgcaaataaactaaatactacctcgagtgctttttaaaaatctcttgtaaaattatctaaatcctttttataagaccttccccaatttatctattgcgttaattaatattcttgcaaaattaccattaaacagaaatacattcattaattagataaagacttaaaacaaagggatctcaataattttagagacactactggaaaaaaaatcgttgacaagtttagtactactactaattaaattagctacattcttttaattcttataaagtgattgaaagaaaatcatatatataggacaagagttagtaaatcatgaaaaagataaggtgaagtttaattgacggggactagcggacaagaagagaacattcattaacccattcggctacaatgatagatatgataagcatattatataggggaaacgaatcagaatataacacgtcaaatgtcttggttgaggagaaaaaagagtgttaacacccactcaatggctcggcagaacaagcaatgaaaagtatacaggaaagaaggaaggatccagaaggggacagggaacatgtagagtataactctactttcctctctccaaataatagaagatctaaatagacagcaatgcagagccaaacgtggatgccaacaatctataatctaatgtttctccattttccttcccaaattccgcttactctcatttttttttattctagagtccacaattaacaactgcaaccacgtccttgacctcaagatgatgatattttggttacatctttgcttgatctgttgtatttcatgtggctgttcactagctgccctgctgcaatggcagacatcagagacagctctcctgctaaaacagatccagcaacaatggtggccaagagtcttgagtttgatcctggtgactccttgcttgcacccttcacaccaagcaaattcaagcaagcagattgggatgcaagttgagtcccaccaccaacagtacccacctgtgagcacaataatgaatcatataaaccttggctattgaattggaaaattaaccaactttatagaagagtattgtctaagaaaatatatggggtgtgtcaaatcacctcaatggaaggcatggtcactgagatgtgaaggtccctcccgtcattgacggcttccatcatggttatgcaatgggaactctcaacattttgagctggatcttggccagtggctataaagatggcagaaacaatgttactagcatgggcattaaatccaccaagagcaccggcgacagcagaaccagcaaggtttttgagcatgttaagctctaccagggcagacacgttggtcttcaataccttctgcaccacttcttccttgataattgcttcacaaacaactgatttcccacgtccctcgatccaatttactgcagcaggtttcttgtccgaacaataatttcctaaaggatcaagtcagtacataaccatcacatttccagtctaatattcccattaaaacaatttcagcctaatattcccattaaaacaatttcagcatgtcttgattataggcatcatatcaaataaaccaacgcattcaagagagtaagagatgcaagcaagttaaataaattggtgatgaatgcaagagtttggcatagtcaaatttttttgcatcatgttcatagttcatacttcatagatcataattaagcaaacaaatcaatctccgaaaataattcaacttgataataccacatgtataatgaacgtctacaataacagcattaaatgacacaagttgttcaaatcagataatacctataagcccctataagcctataacaatataatacaacacaataataataaaaataggctaacacgtatgatacggaaagcttacactagtacaatacaacattgataaaaaaggataaaacataaaaataaatacggaaagaattaaagataatataattggaccactttcatgaaagaaacaattacgtcaatgaaaggagacaaagagccgatatctatagtattagtagcatataacaaagtaaacggcattggtgaatggtgacatcattcaggttaacagaagaaagatccagtcctaataaattaaaaaaggaaagaaagaaagatctagtaaatctcatccatcaaaatgggaaagggaaagaaattaccagaaatgccaataacatccatgtcggggaaatcattctgaagaaaatcaagaacgttttgcacccctttggaaaccatgttcatccccatggcatcacccgtgctacaagtgaatctcaaaaaagcattcttcccagccatagcacactgaataccttgaagcctggcaaatctactcgacctgaaacaccattaaaccaagcaacaaaactcagcgcataaataaataaataaataaaaatctcccataaacaacatctaaattccagtcctctatacaccatatttccttcactcatcctcttcacaattataacaatcaaatcaaaattttaaaggaaaaccatacctttgattctcccctagcatttaaaaaaaaaacattaatgttaatccctaaactgcagaaaattaacttagtccgtgtttgatgaagctaattaagaaaaaagaaaattaatttcggtcaaaaattgattttaaagtgaagtgatttatgtttgattgtttttatattaaaaccaaattagtagtaaaatccattataaaaccgcttcaactcaaaattgagtttggacccagaatcaatcaattcttcaacatgcaaccaaaaacatgattttacctaaaaatataaagttagccggtaccacaacatgattttatctaatataacaagaattcaaacatgattttaatcgatactgactcctgaatgattaatagtgtgtttggattatagcttcatgtcgagaaataaaaaaataaaaaataaaaattcatggtgaaggtaaagcaacaaatagttccttccattcttcacggtatcagcatgattttgtgagttagaaatgatttttgagacacaaaagaggttggaaaagcaaacctgttgaaaacaagtgacaaggtatcaaaattgagaggatcctccaagaaaaacttcaactgtgcagctctcttggcagtggagaatctaacaacaggtgccctcgacatgcaatccctcaaaaccacactgctggccccaccagaagcatagatggccttgcaccctctgttggtactcgccacaaggcacccttccgtggtggccatcggcacagtgtattcgaatccatccaacaacaacggccccgccacccctaccggaatctgcacataccctaccggcatttcgcagcactgccctaaaatggagtcgtagtcgaacccctccagcggcaggccctcaagcgactgccccgtcaggcgctgcagcgccgcgcgtcgaatcgccgcggcgcggcgacagtcgccgaggcgggactcgagcgcgtaggagggcgtgacgcccttcacgacggagtttacaatctcctcgtcatcctcggaggataatataattgaggcatcccgtgagggcaatttggtaattgcgggcgagggagagggagagggagaatctgtaacggcgtcgtcgaggtcccaggcgtcgttggaggcgcgtgagatgaaggactggacgaagtcgatgccgaagaagccgaggaggtagatgaaggaggcgatgagggagaaaatggcggcgatctcggagagagtgacgacgtggagaggggtgtggctgcggatcttgtcgcgccagcggtggaggaggaagtacgcaacggagaagaacagcgtgaagaagatcgcgttggtgaggtacagagggagagggagggcgtcggaggccttgggagaggaagtgtcactcctcttcttggggtggtggtggattgctccgtcgtcagcggcggccggcggccggcgatggaggtccattgtgggagggagagagtgaaagggaagaaggaagaaaaaggagatatgaatgaataatatgatggtggtgtgtgtgcacgtgtggtggcaatgtcgcatgcgtgtgtttgccagccaaaaattgctgaggctgctacgctgttaccagacccaacaccgtcgtttatttgctgtttttctttgtttttattcactaattttcaaacctttttttgtcctttttcgggaaccacacaaacactcaataaatacttgaattcacattttaaataactataacacccactatcaaatacatacttcaattagtgtgtgagaatatttcaatttataagtgtgtttgagttttaatcttaaatatgtgattacattaaatatttaaaagatagattttatcacttataatactcatatccaactcagatagaattatctattattaaagatacttgtaatcaaaatagaaattaattaaaacaccaattatgcatgtactttgacatgataattaaatttaaactaaaaacatttttacaaacaccaataatgcatgtacttagacatgataaataaataagttcataaatagaatttgacaccagttatgtatgtactatgtacttaggcatcataataaataagagataaacatgatttgtcgcaaaaataaccaaagcaccgattatgcatgtacttaggcataataattattttcaaagttgtaaatacattttgacactaattatgcatgtatatagggatgataattaaatttaaactcataaatataatttgaaaccatttatgcatgtacttagacatgataattaaatttgtcagactctttttttaaaaaaaaaaaaaaagaaactagcgaggctcatttgatctatacattactctaaccaatcagaatcttcagttcatatgtcttaaaattatagcacatagtcggaattcgatgtctatacaataacatacaataaaaatcactctaatctcgactttggtaagaaaaaatgatttaaaagattaattttctcgtatttacaaattaacaaaaggagcatgaggaagtatctccccagacttgtctattggaaactatcatcgatctctatatttctaattttttaaaatataatttatttttaaatttcaattaaattgataatattttttagtcattgttaccggcttcactaatgatgatatttttcatattttattcataaaaatatacaaataataaaatatggtattaatttattttatattgttttgttttaattctctccattctaaacatatgaacatactcttacattctgtttggtgaaaaagaaacagtagtaagacagaaaagaaaaaaatataaagaaataggaaacaaatgtgcttagtaggggaaaaaatgagaagggagagaaataaaagttgtgatattattaattgtttttactctacttttaacttgttttatttgtatatttatctcttttatatttctttttttaaaaccatacataaaaataaaacatttttactaaaaagatttaactcaaataattaataaatttgtcatttcctgtcttcaatgcccacttacaaataataataaaaaaactatttactttttttatacatatttttattcactccattttttactctcttttttaagagagaaaaaaatggacccttaataatggttggggaagctttggaattgggactaactcgaacattcgggacaatgcctttgtttttctctcagccttttctaaaattcattttaaggcccacatacaacaaaagaaacaacaatgacagctggggcttttcaaaagcttagcatgttacattatccttcatgaaaaatttaatatttttgttgttgttacaatgaaaagtttaatttaactactccaaattctgtaatatttttttacaaattaaatagtttggacttttattttttattaactagtctttggattctcgttgttattgttattattattataataataaattattctgttccatgttatcaggaatttaaaatttgattaaaacaaagtatgaaaattcaagacataaatgttaatgttgtaggaaaaaattcgtggattattatgttatttaagaattaaatatttaaaatatattctttgaaaaaatcactgttatcttaaaatttcttattttttttaaaatttcatatattaagaaaatagtttttattatgatattatatttatgatttcgtcaaggactttatattcgattagaatttatcgaaaaatagtatttatatcccaaagattattaaaatcgtatatcaattctaattaaacccaactgttgtataatcgagttaaaatctaaaataaatcttcattgaatagaaaatcctagataaattataattaatataatatcatgatcaaatattaaattttaaaatatgaaaatctaataattaaatagtaaacataacataatatttttttaagaacatgtttcataattttttttaaaaagtttaatgggcgtccttttcgtttgttgtaattagtctttcatgctttctgtcttttatttctgaagcatcatctttttaaaaaaggtttaattcttttatcctctaatttattttttaattcaatttgatcctcttattatttaaagattcaactagatcttttattattttttaaaataagttcaattagatcttctttttttaattataaattcaaactcttattaaaagcacacactcatatttaatatctaatcacatctttatagaaattctcatctcaaatatttctgaaaaaaacgagataatatataaaaagtaataaaaactactttcaaattttgaaggtaaggcctttcttcatttaaagagtttgagcatctccttaaattgtcttggaacaaatattgttaaactatttttatgaaattaataggtttggttcaacccgtcactttcttctaacattttcaaaatgacaaattgatgatatgcctttatatgaatgcaacaaatcaaaattaataatttgatttcaagcaatttcaatgttagaataaattgttctaagtacatatggaaggtttatgggttatttgacttatcctataagaaaataactactagataagttttaaattttttttcttagatgcccatcattccacttcatttctattcctcttgttaattctatagattgtaaattatagcaacaacattgtaacactttaagttttgtggaggaaaaaaagtattattcaaagaatttttttttgataacattactgataatgaatttataaaacctcttaaggaatcaatttgttacttcttaaagaataatgtaaaattaacaaataatgattaatacaagtggtaatgagttatatccttttatcaagtgctctaatgtttaaattttattggtacttatatatcaaataaattatgtaagaaataaatattcaccttgtttatgttttatgacgaagatttatcacgactttcggtgagggacaactccataccaataccatgattagcaaaaaatagatcaaataattgttgtattacaaattaattttaaatgatttaaaatgtatgaagatattttttgattttccatacagtgttgagaaatcaaactaactggatagtgaaaaatttaaagaaaattctcttaaccttggacatttgttaaaacatgataaccactcatttattgatggattaggtttacttgaaaaactaaaagttgtaaaataaattatataaaaagatttgattcttttttaaatgcatatattacttatagaataatgttaatgtttcttgtagtcaattcttcaataagttttttcaaaactaaaattaatacaatcttataatttaggatccacaatgtcttaacaaatattaaaagaatagactttattattgattaaaaaatgtttagacaaaattgattacactaatttaataaataattttacatctcaatttttttaaaatatatatacattttaaaggaaaatacaaccattttaataacatatattattattattattattttttgtcaaaattagttttaaaaaggcatcaaacctcaaaattcattttaagcctataatgtaattatgtttaacataagaaacactagaagaccaaaattttctatagtcagttttttttttttttttaagaaaaaaaacaaatgaaatatataggatgaagattaaaggaatcccaattatgttcacacctcttgaactcccatccaaatacaagactatagttagatttatcaaatatagttcaccctagtttattctattttatcagcaacttatcattcactctcaagatctcaagattaactgagattttttaaaccatcgtaattagggtatttgatccttatcctctaacgacactttgagatatttttgcaagttttaatcctttaagatgatgataaaactaatcttcaatcaaatacttaatcaatcttaaagttctttatttctcttcaaagacatgttatgtgataattaatcttaagttctcacttatagtttagctgtcaattgcacaacactcattgattggtttagttgatttagacgtttgtatttagtatatgctcccaactcacttatttatttaatcttaatttatgtttgcttatcctttaataagcatgaagaaataaatcataaaacattcttcatccacattcctagataacaagtatggtgattatcttggaacttgggtaaaatactaattattaaataaaatgtagacttgtagcaaagggtaaaagaaattacctaacataatctatcagttggagctctgtcctaattaacagctttattaggaacacaaaaacatcaacctgttaagatggtaaatctaaagaatacaaagcaacacagaattagactgcttcaaaattatctgaagtctgacttgtatcctgtaaaaagtgtccacacatgaaacatattgtcaattaaaccatttaactgaatacaaaaaataaatgataaataactctttaattaagagctgagttgaacaaaaatcacaaaaggaggcatacagtagaggcaagaaaatatgatcacatgtacacatacaaaaaacacagtaaatgcaacagaccaaatttccccatgtagacataccattctttttactttttagcactaaagtattggtatagatagttggaactaaccaattaggttgaccatgaaacctaaaaattgatcattgattcaatttgagtagttatacattatgaattttaacagagaaccaaagagtaacgacaataaatgattaagttgagttgattcttatgtaaaattaactccaaatatacagtaataaggaaaagaccaaattgtttctagtatcaataaaatcggaaatgctccttgtttcaaagaggaggagaaggattattctcaatttctcatttcatttttttattaataagaaccctaatcactcgatttgaaatttagtcacacttaaagttttttacttctcttcaagaatgtatcatgcgagaatctaactcatgtttttttcatacaagctcagtgtgtgttgtcaattgaactacattcattgaattttattctcatttcatttgagacataggtgatggagtctgtctatgaaaccaacataaaccaagatcaaggcttcaattgatcttaatttttaatgaatgtgatatcatggttctcttgttgcaattccgaccttaaatttttcaccattttcctcatcatgaacattagacactttagctgattgtaatcaaataataccatttttgaatctagattcaaaatcataagattcctttgagcagagcccaaacagaagcagcaatattaaagaaaaaaaactcagataaaagacagttcaacaatgcactctaaaagtcacaaaacgttagaaactaaatacagaacaaatgcagaatttacatagcaacttatgaccaattcagctgctatacgtgcaaaaacccacagacaaaaaaaagggaacaaaattgaggacaaatcaaagtacttacactttcttcttgctgagcttgtacatcattcttgatatttctccctctcttctttcttctagaacttttatttattttcttatttgaaaacattacgtggagcgatgcattcaagtctaatagaacctttccacataaagtgcagacgctgtaaacaaaacacattgaaatttgaatatcactaggatcaatcaatggcatgaaagtccacaattttactaacaaagaatccccattattttcccccattatctcaacttttttttttttaatattttaacaagccaatttcgattgtttacattagtcttatactaacatatttggttctttaccattcttattctttttcctggttagtgaccacaaatgtctctcaattcactaaattatacactaattccgctggcagaacgtaactgttattgacctaagaaaatttacacaatcagaattgaacatagattatcatacaaaatagactgtttccccaaaagcagcgagatcttacacgcagactcttcgggttctacaattctgatatgatttttcacgttccaaatgtgattttaaatatttcgattgtttatgacaagccaaattggattgtttatatttgtagcataaaaatagagaagaaaagataatagtagtaatagttgttaacctgcaagaattgacggaaatgtcaccatagatggtttccaatctggtggggcaaagcctgcaacaatgactacaccactccatctccattccaatggtaacaattgcgttcagtttcaaagtcacataaataagcaaaacagtgtgtcctgaatccttgggaagccagtaaatagctttgattaagcatatacactacacctttataaaaatatatatcattgcatatgttttttttttttattattttgtttttttttattattaagacgtaatctcttcataaattatttattaaaaatgtcattttacattaacattttatttctttaatttgaaatgtaagtcattttcatcatctaggtttttttttttgagttaattatatctctaattttttttttaaatcaagcaaatttgatctctctttcaaatttcgtatacataaattgtttatagggcttgtttatttctattttcatttcctgtttttttattttctgttttgacttttaattatatcattgtaacctaatttttaatctatttcctgttttaaaaaaattgttcaggaatagagaaaagttttttttttcttgtaaaaatatttgaaagcaaaaaaaaaaaaaagactgaaaataagatgatgattttgtaagtaaaaggtgaaaacaaaaacgttttttttaaggtaaaagtgctcttaatttatcttagttttttatattaaaacttcactaaacctcctgcttctaaactttttaaaacgacttcatatcccattaatcccaagtatttggacataaaatgaaaattaaaatttcaaatataagaaattcaacaaagcgatagaatttgcataattttaaacatagagagattaaattaattaaaaaaattaagataaattgtgtctaatctaaacctctcatctcagttgatgcatttgttaatgtacataattgatatatttctttaacaaatttacgtttacccttttttcaaatacagagtattgcatcgatgataacaggtttatccacaacaagcataaagaacaaatcatacggtaaatttttcaaccacaaaccatatttgttaagaaaaacaaaaatggtggttatcaattgcaactttgttctatcagctttcgttacgatgctaaaactacctctacagaaaaataacctgatctagaataaaaagggaaataacgcagtaaaataaagacgggatattttcattgattggttttctaaagaaataatacatttatatatagtcctaagatactaattattcatgtgtcaacatcatgttattttacaaataaattaaataaaaactacaataaatataaaagttcatccaatatagtcttttttccacttaggtttgagagcatttatgaacctttttggacccatcctaacaactttcttaataaaagtcacctatatcaaaataatgtcaaccaaagggattggtttaatatggcactaagcagaactaccttcaagggtgagaacatttggacatatatcctaaaaaaataaaataatataatttggtttccaatttttttaaaagatttaatttcatcttcaaattcttttaaataaatcaatttaatccctaattttttaaaagattcaatttgatttcaaattttaaaaaatgaatcaattcattccttaaattattttaaatcgtttaacttggtcctcaaattctaaaaaaaaaatagaaattagattaaattatttaaaataatttaaaaacaaaattgataattaaacctttaatctacagcacactaagcaacactgattcttcaacaattttcagaatcagaaacttaagctgtgtaagaattaattggttgctttgcttccttgatcagaggacccttagaagctgcatcctgcaataaggatgcatccacacaacatattgtcaattaaatgatctaactgaacaaaagaataagattgcttaaatacaaaaaaagaagaagaataagttagagtttaagagcccaatatcacaaaaaaggaagcattcagacacaggcaacccagataagaaagtatgacgagacaaaaatttccctgtatggtggaatcatggcatgggcgtttacatttaagtatttatcttttttttttttttacaatgataggttcaaacttatgatcctatgcatattaccttaaatctctgtcactagattgaccctagtggttatgcattcaagtatttatctaatagaatgtaggatcctttgtgatggagatcacaatttaggagatgaataggggcataaacaaattaagatcaaggatcatggttctcttattacaatttgaaccttccacagcttcattaatcatgaaaattagacatacttttcaactgattgaaaccagatactacaatacaccagaaaaatcaatcccagaaaagatagttttaaaggtgcactttaaagtctaaatcttcaaaaacatatgaacagagaaaagcataattaagatttacatagcaagttattttcaaaatattaattaacaaaaaaaaaaagaaccaagactaagagtacttacacgttcttttttcacaatttttacattgctctttctccttttctttattcttctaggatttctacccaagtctaataaaatcttcccacacatggtgcaagagctgcaaaatacaagacattaaaaatcattaatggcgtgaaaatataataatagttccccccaaaaaccttaagaggaaagaaaataggaacaacactagtaatatatatacttcacctgcaatatttgcctgaagattcatcgatgatgttttccactcttgtttgacaaaacctgcaacaatgatcgcaccactccatctctatgaaaacttttgtgatcaatttaaaattgctatagacgctgtcttatttcttgggaaccaagtattgcactttgacgaggtatctataccacacctttatatattttgcagaggaacccaatttttgtagatcatccttttcaattttttattaatgttagatttatgttttatttatttgattatgcttatctttcccgtaattttaatcatgatatattttataaagatttaatctctcaatatattacatttttttatccgctcaatatattatcttttaattttttttgtcaataaattatggttccttttttgcaatattcaatactttattttttttgtatttatgtttttaaaattgtatgtgaataaatttggatactttttttcggtgtactggatacttttatttatttatttattattattattattatttaagattaaatgaatgactggctcaaaaaaaaaaaaaagattacatgaatgatatgcataaataattaaaaaaatatttttttagaacttgtataattttcttgtaacatactttgtgtcattgcggaggatatcctatcctatctaatctaattccttcttcatgtattttgttaataatatttcacccttccattttttttatatatttttataataatttaattttttaattcaattttttcaatatagttaaatttgtttggttaggaaaactcgtactattaattgccaagtatgttaggttctaaatattactttatatatcacatgatgaccagagacggattcaaaaatttattaaaagagttaaaaaaattctttataattatttaaatgtctaatttttaataagtaataatatttaaaaaattattattttttcacataaaattaaaactatttttttatttaaatgataataattttaaccattatcataaaaataacaaacacaattaatttttcaaaattttattataattgtcaccttaatcattataatagtgatttcttttgaaactttttaataaatgtataaattttttatattattttaatacagacaggaatacaggatcatgcaagtaaattagttatttattgacaaccattgatacaggaatacaggatcatgcaagaaaaaaattgatgacgtgaagagttacattgacataaaataagttggatatacatatactcaacctctaaaaatgaaaaaaaaatatttaaaaaaatttaatttattttataaaaatttaaaagtaattccttattttttcttatttacctggtgcatctttccgtttcgttgaatcctgatccgtaaacaaactaggctccataaaacttatcagattttgacaaacatagtgcatgagaccaataatcccttgacaacagcaccctataattctgcttgtgttaatatccctccaagagcaatgaacccataccagtgaccaatgtacactgtttcccgtgctgctcaaacgcccaccagctgtttgacctaagtccatgccaccagttacctcaagaaaccacatctaccagttgtgggaatattaagttgtactttacttgatttacagttagtgggggaccacatcagggccttgttttgttgatttgaacccttgcaagaatgctcataagaaatttacattgtcacaaagtccattctctgagcctaaggtgctttacttctgcaactcctaatgtacttaagcctggggatgtcttgagaaaagcaagggtttatactgaggaagatgttctccaatactccaaggtgagttgtgattctaatcctttgcatactgattctgctgctgccaaagatgttggatttgaaggtccactggtacatgggatgcttgtggcttctctctttcctcatatcatctcatcacattttgtaagtttcatacttaccctctctttaaattttgatatgcctcctaaaatgagatagttaacgttctcatctcaatattaaattaatgtgaataaacagataaattagtagagttctattattagttttctagactgaattttatactctgtactctgtagcatacatttttacatgtaaaagttaatttgtttgtgctttttgtaagtgtgaaatttctgccacagtcagcagctttggggaactctaagttgattccgggtccaaatccccttgcccccatgaacatcctttctgtaaacttgagtattagacaccataatggaaaattatgacatgagatagagtatcataaaatgaagacggataagatgtgaaattgtaatctgcactataaggagtgtgaaataaggtcaagtgacccctcacttattgcatagattaaaatgtgtcatgattaatcagaagtaggaagggagacacatgtaaaaagcttaaattttatagtatttctgaaggacatgaaaatataaacatggataaaggacttatcgtgtgtctggattggcgttatgtcagtgtgatccgcgtccttttgaagtaaatttttttagcttccacggcatacttgacgtgaatttggttttggatgtggttggaaagtgcaaatcaccaacatgctattaagtggtcaatttaaatgctaacatgggttctagttctactgcttgaaaaattggtacttgtcattggatttggtcaacttgaataaaagacttgataaatgatgtgaattgaggcaatgctatgaagtcattcattgaaatattctcattctgtgataactttcttaaattcctcttcttccctggccacttcaatctttaataattgcagcctggagctgtgtatgtatctcaaaacttgaattttaagttcccagtctatattggagatcagattattggtgaagtgcaagcaactaatctgagagaaaataaaaatcgatatctgtaagtttagtcctgctgttattattgtgcattcttttttaaacaagtagtaattttgtttctaaatgaatgtttctcaatgctattcagtgcaaagtttaagacaaggtgtttcaagaatgatgaccttcttgtgattgatggtgaggctgtggctttgttaccaaccttgaatgtagaacagattcaacacgagccgtaaaagatattcactgttcttgactgttaatcacaaataccttttcaaaggcaatgttggtcataaaagtaatatgtttgttgttttctttctaatggaagtcattggggttctaaattctgatcccctaccctgaacacggacaaacagcagacaccaaaaaagtttttgttctctttgctattctgatgttggtgctgaacagttatgcttgattttttgtgtgcttgttgatcataccacgcaaaagttcacttcattgcactgagcttcaaatcaaacggcacaaagagatcttattgatatttttttttttttgtcttttgtgccatctaatactattggttttggaggaaatgtttaatgtcgtaacaagttagattttactttgtttcgtgcccatacggtttctctatattttgtattggcaactgcatcgcatgaaaccaaaaaatatggtcccttattaatcctgttgttcctccctatatagggttcatttaaatccaacatttgcagtagctatttacacaaaactaatggaaaatttgctttgttggtaagttttaagtaatatatagcacatgatccaaaattgttgatttgttaaaaacgaaaaaaaaacattaaaattagttcatgataaacaatctctcttccctttttttattttatctttttctcaaataatattgtttggcattactattataatagtagtatgtgcgaataaattctttatttatttttgtgtacgatagcgggacaatgaaatttgaacttacaacttcatataaactatctaaaccacaccactaggccaaacaatttattagtaaatttaaaagataccttgaattccatagtttaacttaccatcacacaaagtaaaatcaatacaacaattacaactggtgctatagtacatatggcctaccatttctagtaactggtgttatcagaagagatatcccacatcaagacaaagattaacaccaaaggtatttggttgacttgaatgccatctgaagcacaacaactttctggtgaaggtgctggagtgggtgcagcaacaccttcagtaacaaaatatagcaaccttcatcccatgccaacaatagcctcctccacttaagaagtagtaggtcttgaattcagttagatgaaacacgtctcttccttcaccccttcatatgttatgaacaaatcctgtgtccatgcaattctcataactaagccttgttcacctctagtacattgtactcgttcctatcatatccaaagtcttgcaagcataacaacatctaagtcatagtcaaaagataaagtataataatctacattaataaattaatctacaattatatgtgccctttttaatgactttgactcctttttctcgcttctacattaataaatttagtaaataattaaaaaaatatttactaaatatattgttgtaattatgaattcaagaacttgccgcaaactaaaaaagcttagaaaaattgaaatataagttaaatttaaagcaaaactaaaatattttaaaattaatttccttcaaatatattatttacttatttcaataatgttattctatttaatgtaatgataatataaaaaataatatttttaattttataaaatatattatttaaaaacatgtaagacctcacaacaaactacataaccaaattggttagatttggttaatgacctattctaattaattgtatactagtgatcatttgttaattgataaaatttaaaaataatattttatattaaattacccaatttggttagataatcttgggtaggttagttaggaaatccattaattaaaatgtatcattttgatcttttatgtttttggaatgtatcattttgatcatttttaatttaaaaattaacgaaatacttacgcttcaaacgaaaaattgaaaaaagactaaaataatacattttaaaaatataaaagactaaaataaaacttttaaaatttaatatatataaaaagtaaaataattatgaaacataataaactaaagaggaaaacgtaaaaataacacgtgattgaaaataattatttttctgaaaactctttaaaaaacagcaatagaaatagaaaagtaattccaaagaggaaacaagtgggttggttgtcagcggtggtgaacttagacatgcagtgggtgcacaccacaagcgcaatatcagaggaaggaagcatgcactgcatgcatgtacctacccttttcaattcaattatgcatcattctattattctacgtctctctctctctctctctctctctctctctctctctatatatatatatatatatatatccacccttccaaacccactttgcaacatccatcaaagccttttctttcgttgctacttattcactttcattctttgcttcagaaaattaacagtgttgaagagatccgtcaggcacaacgtgcagaatgccctgccactgtcatcatggctattgcctattggcaccaccactcctcccaacttcattggatgcaaggcaagacatggtggtcaacccaagtccaagattacccatctcatcttttgcaccaccagcggtgtcgacatgatgtaccaccaaggctgctttgccggtggcacgatgcttcgtctggccaaagaccttgccgaaaacaacaagggtggtcgcgtgcttgtcgtttgttctgagatcactgcagtcacacccatcttgatggccttgggggtcaagccttgtttggagatggtgcaccatccttccatacagtgaaggggctattgatggccaccttcgccaagttggactcactttccatcccctcaaggatgttcctggactcatctctaagaatatcgaaaaggcactagtgtaagcctgaaaaaatggaagctactagacatttgctcagcgagtatggtaatatgtcaagtgcatgtgtgctattcatcttcgatcagatgaggaagaagtctttaaaatttattataaaaaatagaatttacttttccttttaagaatgaaatggattgtaatattattactaaaagttggtcacgacctgcacatcaaagtcaataaaagaaagtaattgatgagaaaattccaatatctaatccatgtacaaatatcaaaatccctaattacttgataagttcactactcttacgccttacaccagaccacaacctatgctaggattaaagaatcatactatggtgaaaatagtacagatagtacagcttccagcaagccttgtattccaatgtggtcatcacaattttcaaatccactaagttgaagagtcctgctgtttgatggattcacgtgcaatatttgttgattttcatgaacttgttgatatgcagaatcaaatccactcatttgatgagtcatgctatttggtggattcagcggcaacatttgttgtttttgttgcatttcgtgaacttgttgaattccagtaagaggaattgaattttgtggatcaatgatgcaaggaacgtcatttgtgtaatgtaattttatatcatgaatgctttttctttttttctgtatgggtgaggcattttggcgaatgaaatacttttgggcatgactggcaatttgagtaggggatcttgttttaaccaaccttgatatttctatccagtttcccttcccatgtttttggagcccaagtaaaaacaacctgccattaaaacacaaatataagatgaaaaattgagaaacttccattcatttgagttttatacaatatattaaaagcttacttatgttcttcttcagtccatggattccttctcccttgcttgcgccgaaccgatgaaccagcgttctgcatcatggaaccaccaccgttatgcaccagcgcctcaactgggtggctgggcaactcgaccggagcccacgcaatctggttcacgtgattgggcaatgtctggtggtgttgggtgtcctccgcaactagggttgcaacgttcagcggtgtctggtggtgttgggtgtcctccgcaaccagggtagcaactttcagcggtgtgcggtggtgttgggtgtcctccgcaacctggatagcaacgttcagcggtgtctggtggtgttgggtgtcctccgcaactagggttgcaacgttcagcggtgtctggtggtgttgggtgtcctccgcaaccagggtagcaacgttcagcggtgtgcggtggtgttgggtgtcctccgcaacctggatagcaacgttcaacggtgtctggtggtgttgggtgtcctccgcaactagggttgcaacgttcagcggtgtctggtggtgttgggtgtcctccgcaacctgggtagcaacgttcagcggtgtccggtggtgttgggtgtcctccgcaaccagggtagcaacgttcagcggtgtgtggtggtgttgggtgtcctccgcaactagggttgcaacgtgcagcggtgtgtggtggtgttgggtgtcctccgccataggaatctgggtagcaaagttcagcgtcgaccatatatcatcgcaatcaaaaagcagattgtagtcataaacatcatcattccaatcgttattatataactcagacattgttttcttcttttatcttttaatcttttatggctttcaaagtttgaagcttcaaactcaaattgcctttctttccgttcactgggcttcttatttaacaaagcatgacgcgccattctttaaaaatttggcgcccaagtgacattcattattcattaaaatttgaaatttatttttttttctttcaaagttacttatccaaataaatgagaaattatagtaacacatttttaaaaagttattttaaacacaatatttattattagttaaaatttattagaagtcacaaattttaatgatcctacttcttatttaaaaactttttctcaattttatagtttttaataaattttaactaatattacatatgtgttataaatagtatgttagggagtatattattaacatttctctaaataatatacataatatattattatataaattttatcatcatcttttcaaattatatgtttattaatttattaaagttgaaatttacataattatattaattaacttatttataagtaatttcataattttatttgttaatattatcactaaaaagtgagattttaaataattttttaagaagtataagacttaaactaaattttaaaataatttatataatataattaaactaaaattaactcttatattttaattaacagattagtcacaaatctttcaaaatcgagtcgaccaaagttgatttccttcctacccttacactattatttaaataaatgcactgcattcgtcaatattcacctatttttatttgaaaatctcaaagttgacaaaaaaaatagatttaaaccaattaaaatatttcaaatgattgaatataataagattttttagatatttcaaaatttatcaatccaaaaaaattagattgatttaattaagtaatttgattgatttttttaatttttaaacaaaatatattttagaatttatttaaaagataaatgaaatattaaaaagtcaccaatattactaaaaaatagagagggaaaagcatgatttggtattaggcatgacagcggaatccggctccgtggggatcgaatcgaactctctccgactttgacggggaaaaatcaagtcgaccgggtttggggtcggggtcggattttccctgttaattaaaaccggggggtatgggataactgatatccgccctgaacccgccccgtaataaataacattaaaaaaattatatttaagttgtttcttttttatttatgtaatttgaaagatgtgatacttaatcatatgatgtgctacttaatttttggacaatatatatttaaatgatatcgtattttgtgagaaattaaatatgcatgtccttattttatgcaataactatattttatgattttaattaaattaattaatttggttttgtaatttttaattatgatctcattctcatattttgaatgtgaatttattattattttttttgttatgtaactagcattttcggcccattttttcaataacaaaagttatattatttttctaatttttttaattttaattaattagcgagggcggatcgagacggggaaaatcgaccccatcaggaatgaggtatatatttttaatcccaatagggatcggagagcgattttagagtatagggcggggatggagaatgcaaaacccgtcctcgttgtcatgcctagtaaaaatgataaattagataataggatttttttctaaacaacaaaaagatgattttttaaattgaatgaaagagtaaaaccgaatgtcaaataaaataataaggataaaattaagagagaaaaattaaactataagctaatttattttttataaactacttcaaataatttatgaaaataagtcactaaaataaacttgtgtagcaaagtagtttataagataattaccaaatcaaagaaacttaagtattaattacaaaagaaaaaatactcaaaatagcctcaatattgtgtatcaatatttttagaacataaaaagtaatttattgaaacagaattcaataacatcaaactatcttaaaatgtatctaataatatattgttataattaagaattcaaatttgacctcaaattaaaatgttaagaaaattctgaaatataaaatttttaaaatatataaaaaaattatttaaatatatgattttctcatttcaatgatgttcttgtattttgtgcaatcagaatttagaaaataatatttttattttttcaaaataatgattttgttttaaaaagagcacacaataaattaagaaacaagaatacttgatatagaataataagaacatctccaatggaaagtgcttatatgggtttcttagagtcatttattcatttttatcttcaccgttcataaaatttggaaactgactggcatgttttcattggctgtgatgatgctaaacaggcttgacaaccaccaaaactatgttttcagcttttaaactcgattccattacttgaacattaaataattttttggttttgtcatgaatatctccatttcagtgactaattttacttgctataaacattaactaatttttttttatcaagaaacatcaaataattttttcttttctcttgtcttatttcttctttttcttagcatttttttttttaaaaactttttcatatttaatattgagttcatctactaccgatttcaattaacttagattaaatgtgatgttgatgatgatgaagaaacatcaaataatttaaattcatttcatctgacaccgcatataattgttttaccttgccttttatctttttcacagacaatcattccaaaaatactctcccaaaattaaacgagacaactagtcccattttagttgtaccaaaaacattttgctttataaaccataccaataacaatttggtaagacaataattgttacatataaattaaatgagcacgccaagttacaaagtaagaagattcccactcttattgttcaaatttggcaaagatataagtacaacccttttcccccttttaacccccaccaaaaataaaaacaagaacctctttttcttatgctgtaatgtcacaacttctagtctatcatcttatgtacgacatttggagaaaagaaaatctgtctctcaatgtttgcaagatccaccaaagaaaggatgcagtggtatataccatatagaatgatccatcaaagaaacctgaaaagacttggctattagcaatcctcttgatgaggcataatcaactcaaccaaatatagagaagaaacaaacaatcttctttcaaaaagtaggccgctactccacaacaactcattgttatgttgttaagagttctcatcaaaattggggatgccatcaaaactctgccatatgtatttaccatttggacatatcactcaacttaattgacatcctcttttaccatactcttttctttggcacggaaatcctccaatctaggatactcttctcgaagcaacctgtccagttcagggtgttgattcaacggttctttctggccacggaccttgcggtaatgatgaaatgccctgccaatgccataaatataaatataaatatgtaagaacaaaagttctagagagtgataatatggtgaagaggagtgccaaaacaacagaagaaaactacatttctctatatctaacagatatgagggagacagtgccttgccttagaatatggcaacctccattcacccaaaaatatagaaatgcaatactaataaaatagtatgctagcatttgacatagaaactaacatatttccaatatgatgatctattttggattagctaagcataggtgagtagtgttataacatgcacattcttaacatttagaactgctcatactgttccacaaatctaccatcaagaataaacaaaatgctccatttcagtccaataatgcagtcagaaactatgttataaagattttgtgacacaaacaagtcagacaaacaggaaataatcaaatataactaaggtactgtataattagatttcatagaccagtgaacaatctttttaatctagaatacaacttaggttatacactaaccaaccaatatgtttacttctttcactataacaaatctcacatgaaattgggaaaaggaatgaaactacaaaacagaaaatatgcagtagaatataagaagcaagagaatttggttttttaccaatatttttccaggccatacagattgcccttatggtagaaatccagagtgagttgttcaaaatcatcgtataaatcatctctaaattccttctccaatccataactgagcaagaaatcattcaaaaattagaagaactatgcttggatgtcttcaaaggaaaaataaaaataaaaatagacaacataaagcaatttaatcagcttctccaaagaaacaatagacgaaaattcagaagacttgaaattagcctattactttactcaacaaaatggaccagaagatgaaatctaaatgatggttctatcttctcaaacaaatgagaaaagacagaattggaattggtacctgtaaaatctgaaaaggcactctataccataattataattagccgcagcatcttccttagctaatttcttaaattcattatacatagaaggcacaaacatgtctcgaagaaaataggaccagaatctgtataatgtattcatttccctgcattgacacacaaaaggaggtgaaagaaaaacctaccagaataagcaagtgtatgattgaaaaagaatataatacaaaaatattaaatttgcaaataatatgaaaaccgaaatgtataaaaaaaatatgaatgcataatatacaaagtgagctaatgaagatgacagcactgcatccaggctcattttgatatgaaagcttcggctaatgacattgttaagttaaaaagagaaagttgaccaatgcaaaccaatattgaaaatgccacgtgtcgtaactattccacaattttcactcgaactattgcaacatactcgtacacaaagtactttagaagataagtcattcaattaacaaattaagtaataaaaaaggcaggcaatatattcaacattcggtgcatgatgcacaataaaagtaacaggaacagaaattgagaatgagttcaatcggtgggctaccaatgtggttctttacaaatattttttcatagaaacgtaagaaatggagttcacctagctgcaactaattccaagtttctttctatcattcaggcaccgtttgtgatacttcaagtacctgaaaggaagaatactaacatgaggaatttttaaaaagcaagtcctataggactatatcctagtaccactctcatgcatacaaccagtatgcattatcatttacttctgttgtttgaaaccgttttcttctaaaagttggtgacttggatgctgaaacggcggaaaagaggttggcattgaacccacaggcggactaccagcgaaacccccatgtggactaccagaaaaccccccatggggactactagaaagaccaccatgtggtgaactactcaatttggaaggcttgaaactgcaaatttaagataattaatggaaatagcttcagttgtcataccaaacaatcaacatgtcatatcatactctctgaaacagtaataatttatattcttaatttaacaaattatttactatatattcttccagtaaaggataaaagtgaaaaaaaaaaaaaaaaaaaaggctggctaagcaaaccaatattacagtcattagcactgggaacaatcaatttgaactgacccgtgattttcaggaggcgtagaagcaaagaaaaacccaaccgaattactaggcgggctttcagatatgattccatgagagtttcgaccagttccatgatttctaaaattacttgagaaaaaccgctgcttaagggaagatggttgcttgtgaaaaactttttgtttccttcgagaattatagcttccagactcttcaacactgtttccaccaatattctcaactgcctttatatttgatgcacccgaattatggcttggagattttatgtttcgatctctgctatcagagttattctttctacgattagaccgcctatgtttcagttcctgtagataatgggtggggcaaccaaaaatttaataaagatgatgacctgaaaaataaaagacaacagggaaaataagaatagtgactcaacctgctcgtagaagtaaagaccatcatttattgcggaagcaagctcattggtaatggatattgattctttactaccacctctagatctttgtttaggatcaccattctgtacagtagcacgtagttattagaatcttacaattcatgatttgaatcctacgttcaatgcttcaatacgatacatctatctatagattgtatcataagatgaatctcatttcattctttttttctttacctttcttttacctattcacgtgaaagaaattgagaagtcatataagcttaaattgttaaatggaaaggaatatgatgagcacttacaaacttatcctatttgattattgcacttattttatttgtcattcattcaatgcatgcactctatttagctatttcattgctttgttttcattcttctaaaaatagagacttcacaaactaattttgttttataagatgtttgattaagttgtttttatctattttaagtttaaactattacattaagttatttttcattgtctctgaatccgatttgatgcaaataatgattcacgatttgaattttgaacctcaatttgataaccttgctttaaaatataaaattattaaataatcaattaattgtaattaacattctaacatattatggttaaatcagttttcgttcaaacaaaaaaaaaaaaaaaagacattacatagccgtatagttataacttataattaagtagtatacagagcaatatagttatgtagttcccgcctctgaacatccatcaaatcagaagaccctcaaattattttaattttcatcaccattgctgtttgggcaatatgaatgtaaaattgaaacctaatttgaatgataccactttagaggaaagaataaacatatgaacttgatttaaattaaattataaacagcaatacctgggtgacaattactagtctctgaacatcctgttcaatgacagtcatctcatcatcttcatcatcattccttttagacaacaacttccatcagatgaatatttgaacaaaaaagtgaacatatgatatgcttaatgaaaatggcacaaaaatcacctaatatcattccatatgggatgcctaaaataaagacaagtattctaacatctcaaacagaatactaacacagttttaacaaggaggaaaagaggaacctttgaatttcacattatgaataaattaatagttgtcttttattaacttcgaagaaaattgtggaaaatatatagaggaacctttgatattttatattattacattttttttatccgctcaatatattatcttttaatttttttttgtcaattaattatggttccttttttgcaatattcaatactttatttttttgtatttatgtttttaaaattgtatatgaataaattttggatactttttttttggtgtactggatacttttatttatttatttattattattattattattattattattattattatgatttaagattacatgaatgactggctcaaaaaaataaaaagattacatgaatgatatgcataaataattaaaaaaaatattttttgagaacttgtataattttcttgtaacatactttgtgtcattgcggaggatatcctatcctatctaatataattccttcttgatgaataatatttcacccttccattttttatatatttttataataatttaattttttaattcaattttttcaatatagttaaatttttaaataaccaacacacaattaattttacaaaattttattataattatcaccttaattattataataataataatgaaaacaactaattttatactaactaatcttaatggttattataattattatataataaaaaataattaattttatattaactaacttaaaaataaatatttatacgtacgagagaagtgtcaggactcaggagagggtctgcccccctctccatccgtgatgacttttatcaaccctgatttttcttttcatatgctaatatttaaagtttaagcacgcttggataaattaatatttaccatgtttacataaattaatgttggaaatgtattaccattccgcaccaaaaaaaatgtattttcattaaatccaaaatccaaactgcaaaatttattttttccacttcatcatttcaaagtcatttttaagttttatctatatatccacataataatgtttaaagtaacatattcttttattgacaaatattaattgttaatttattattatttgttaatgagaaaattcaaactcactatattatatttttttcttcaccactaaatcaacctgtttttatttataaaaccaccaagccaactataaactggcatatacgggtatacttatatacatgtctaattcatttcattgaagtttagtatttattacattttcattttttttaaaatcaataaagatcctcacggtagtaaaagttcagtaaacatctttctattttcatatgctttcttctttccaaaatataatttttattttttaattttgtttgttccttttataagatttttttcaaattatcttttgcattaattatattttaaccaaaatattcttaattattttacgataaattttatgaattaaaatgataatctcaatagtaaacctgttttaaaatccaaaccaaattgaatggtcgaaaatggtttgactagatcaagttggttatcagacaagttatgcaatcaacttggtgcaatccgattaggtttgttgataaataagtaattaaccttttgatcaggaccaaatcatgtaacttttttttgctttaaaatgactcaaaatgacacaactttcttgtaatgtgattattgatttgtgtttcaatactacctcaatttgttgtgtttaaaaaatgtctatacttaataactttaagtacttgacactttgattatgtttatgagtattttttttttaaactttttaatataatttttttatattatttttatatagacaggatcatgcaaataaattagttatttattgacaaccattgatccaaagctttaagtatgtcgccttaactatttcgatctttaaaactatggtagtagggatctataaatttattaaacttacgaaaggaaaattagaagaatatccatatacgttactgattttgtgacttcattttggtttcgttaaaaacaacttaagtggcagactcgaataaatgtgtttctgattctttttcccttttatttttgagactagaccaaatttgacaaataagtcacattgtcaaaactatagatatagtatcaacatgtgtgtcggacgtttttgaaaaggaaaagatgtaaaacttaaaaggactaaaagtgttgtacatgttactgacttaatgtctattggcaagtacaattaagatacaaaaatgccacgcactcatctccacgacaaatggaatgaacaactatgccatacattggtgtcaaaactgttactgccaagtcattggatacagaagatcttgattaaattcacatccaaatcacatgctcatctttcgtctccaaaatgaagattatgtttaagacctttgcttcttgggtttctttcccgatgcttgttctgatgatcctacaatatatgtctcggcacttatattttcttcagatttacgcttcccaaacttctctgtttttttctgcggacgaaccattttgaatttaagtgagatgatgatttatttaagagaaaataccagttaggcaaagaaaccaacaattctaactggtcaaacaagaaagagaaaaaattcttaataaagttccgccagaaacttatttacctttaaggacattgccatgttagctacattattgttagcatcctcagatttatccaccagatttgcaggctcctaaagtaaagagtgcaaataaaagttttgaaaaaaaaactataaaatagtacgcacgacataaattgttgtgaatagtagagaaaatcgcaaaagaaataacaatataaaccttgggtgggataaaggcctcttctcttttccttttgttttcagcagttttctcagcctgcttctcctgcttctcttgccatatctttgctgatttctttttgttacttaaaaagtattctccagtttctaattgtatatcaatctgaaatgtcacataaattaccaaagacaccttaaaatttatttcatagattaacaaagtaccagaacaacatagtttgtcaaaaacttagatataatacagatacactaccccaggggggaaataaaagaaaaaagccaatataagcagagggcagcaagtagttgtggaattggtgttgtcattctcatttaaaggccaagatgaagttcatatattcacaaattgctcctagataatgcacacttgagctaagtctgatacactcgttatgatagaaagtagaaacccaaaaaaaatacctaagatacccacaaggggaccatatcaactcctgaagataaacctcaaagttgaatcttaatcatctttcacaatcaatcacctatgtatgtctattgccacaaattaaagtggaaggtgatacccctcaaaatatcagttagagacaaaatacaaggtttttactttaaaaaatcaatagcaattaccagaaactatgataggaaagcaaatgcttaaacactaattacaacatagccagaaaatgcaggtgggcgcagtcgggtcctactacaatacagaacaaggaaggggaagaaagggattcgaatgagaaagaaatcaggctgaggaaggagctacaggaagaagtctgggtgacagtgcaatcaaaagaatcaaaagactagccataacagctggcggatttggtgggttgctctcacatggtgcatttggaatctcagaaacagaattgttttctcaaatgaggagtttaatggacagaaattgatggaggatgcaattttcttctgctggatgtggcttagatatttagagaatgattttgagctgccattccacttttgggctagtaatattaaatctggatttttgtataggggagggattaggccatagacacttttgtaatgggtattcctgtgtgcctagggttgggcattatggtattctaatattcatagaaaatttccataccataatcttacgttgataattggcacactcggatgtacagataatagtactactggtactacttatatatatatatatatatatatatatatatatataatacataattacatacatatttttgctagtcaattatttactttgttgttgttggggacatgagtagaggagactctgtacattagtggaagaaatccagcttgatcagagatattaattagaggttgtcttaccttactgggctgttgaggtggagggaaaggagtatatggtttcttctgtttagtgttaaccttcttttgcttaacatttttcctacaaaaagatatgaagcatcaatgaaactgaagcagagggtgggtgagtaccttgaatatacaatttatcaaataaataaaaggcatacttcttgaattttggaaggaacctatcccagttctcctgggcaagtgctggatccttttcaagttctttcttcatcataagaacctgacaatgtgaaaagaagaattgagatattttctacgcccaaaatctataccacaaaggcaagctggataaaatacaaattaaataaccttaatgttgtatacaggatgcattttattcagcatgcattcttcaacaattcttctgacttgcttcaagcctttgaatgaacccatagcagcaaccgtgtttccctgtggaattgcgtgcaaaattaaaaagaaatcagctgattctagactacactcatatcatagtgaaagtaaatgtacagtcttcacattctaaactatgaagcataagtcaaacttacttggacgagaatgtagcagccagtgagtatttcaagagcctgcaagccagtattatagttggagaaaggtgagtcacaaagttgaagccaacaattggtggtaagcagtaccagaaaaccaaagcaagaaagtaacaacaaagggtttatcccacaaatgctgaaaaaataaaatcttcacaaaaagcacaccttcaaggtggaagaattggggcccacaagatgttgccttctttttacaaatcgctcctgcagtcagaaaatcaagggaacttcctaccatcagactaatttctttgaaatgcttaagttgcataaagtattatgacaaaatacaaaaatcatatggtagaatacaaaatcaaaagagcagttcaagtaaggataaggggaaaaaataacttccatggcagcccgatgttttcaaatttctggaatgttactaaggaaggtctcctgaaagtgcttagttaatttcattgcaatggaaagcttgaagtgtgcgtgttcagttcaaattattttaatgtgaatttttttagcagctaaagagaggactttgggggtacaattcaataaagcttaaccaaaaatagcttatgaattctatttgtattactctagtgcctaagaaggtaatagaacaccaattaataaagtaataaattattatattgaacactgaaatcacacacaacatggcaatacacttgctgccccagaaacaaaagtccactgttacacaaatacagccacacccttgctgtcccagagacagaagtctcagtattctctttcaacaaactgaaaataacttgacagttgacactacctactgtcagatatatactcctgatacataactactatcagttattttctacaaataactgtcataattgcgtctaaatctcagttcccatgtatactaagacgaatgattattgctccacaaatcttgtcagtagtgcatacaattcctgaccaagtgaccattatcatgagggtagtcaatcacacgcagtagcagcactatagaactggcagaggcatcatcgctaatagatattcaaagataaaacaaaacaaaaccatagaggcacacagcaatcaagaagaacacgcagtaaaacatttgcaaaatcttcggagaaaataccttattacgaaccatgccgctgattttaatgatgtcacattgcgtctcatcgtcaagtatttttatcgcctgagaacaatcatagcaacataaataacattaatatgactgaatttttttttataaaaaaaacagaaagaagttacaaacacaaacacacacacacacacacacacacacacacacacacacacacacacacatacctgaggagcaggaatacttcgtgatagaagcttgataagatccctggctttgatgataatataggggtccctagtcttcctggtggttgaaacagtcatggaaccctcaacctgtgcattgtcacaatcaaaggcgaaattagggttttggattgaaactagaggaggaaaaaagagagtgagtaacagagtaaggtagttacgaggttgagttcgcaagcaacaccgaattccttgagagaggatttgaccatgggccaagcttcttggaggtacttttcgcggtactgagggaagagagtggagaaggagctgacttcgagcatgccgccgtcgttccacgaagggtcgaacttctcgatcttccagtggtcgatgtttgggtcgtcgtcccatggcttcggcttgtcgtgcttcccctttcgcttctccttctgttcaagtgcttgaggttcttctgctacgccattctcctcatctgagtggttttccatcgctgctttctgttttgtttccggtgcacttgcttctgctaggttttcaggttttgtgggatgctatgctaatgctattgacctattgtttcaactttcaaccaaatgacaacggttgaaatgaaataaaacgtgggattggctttgggcttagagcccattcattttaatacttcatcttagtattttaaaatgtgtgtaacttcatttttatcaaaacttcttggctaaaatattgtacttgtataatttccccactatataaatatgtaacctcctagaaggttcttttcgagataccgttggacactaaaggtaagtatctctttcagtggagtttgaaccttaatttatcataatgtgaaaaattaatccattctactaaaattccgttagctatacttgtataattaaagagttatatatatatatatatgttttgtatttcaagatatttaccaataggaattgagtctagtaatctataacatgacaaattaatatttgaattcttgttgaaaaaaatacatagaatgattcaaccaaaaaataaaaggatatacaatttacaagaaagttcttaggtacgaataatatgaaaagtaaggaatgaaattttatcaactaaaaaattattaaacatacatgatggttgaaataaaagttaagttttcataaaatttctttgcattaaaattcctgttatttgttaattgagttcttcgtactaatgatcttttctttagaatgttagtaacacattaacatctttcgaatacattttttaattggtaattgatttttttagactcgtggaattcttatgagaatttcacttcttatataataaatttgattgtcgaagaatattaaatataagttaacataattaaaatgtaagaattatattttgggttaatattttcaagaaactacaaaatcttaatgtttgattcgataatgaatgtgtttctgatcttcatcacaagtgtaatatatggtgtaacaaattgtgggtatgggtatcatcaccgaaccaacattgtattccctcaactccccaaatttcagattttcttaacgaaaccttaccaaaaaagagaggtggtgctaattattaatatattaggatttaggggacccgtattattttacgtttctttggcatgactagttttgaaaaaattcatggaggttttggctatggtacgaaaaatgagactagagaatgtatcttgaatgttgcactaacctacgatttgatactagcgaacacttttttccaaaaaaagggagtctcatcttataactttccatagtaactaaaatcgtagtcaagttgatttctttatggttagaagagaatataaaaatttttgtattgactacaaggtctatcctggagagtgtgtcgcaacgccacataagtttgtagttctagaggttcgattcaacaaagtacttagtatgaggaagatgactcaaaacccaattataagatgatggcagctaaatgaggaaaaacaaatagagttcaaagaaagcatgttgtgtgaaggatcgtggaagtctgtaggagaaacaaatgaaatatggaatgagatgactatgtgtatccaaaatgtagaaaggaggatgttgagagaaagcaaatgaaacatatttcttacaaaggaaacatggtgatggaatggagagggcagaaggtaattaaacagaagaatgaatgctttacatctttgcataaaagtctcaatgatgaaaacttgcaaaggtttagattagcgagaaaaaaaaagcaaagaatgtaatgcgggaagctagggacaaggtttttgccgatttgtattaaaaccttgggagtaaggatggtaaaaaaaagtatataaaaacttacaaaaatgagagattaaaagagaaaagacctcactcaagttagatgcatcaaggatgaaaataaaaaattttggtaagagacgaagatgtaaatgaaatatggatgaactactttaacaaactttttaatggaggtggagacaaaagtgaggtcgacttggagaacgcttatgatgatctaaataaaagatttgtgcgcagaattaatacacatgaagttaatgagactttaaagaggatgaaaaataataaagttttaggacccgatgacgtccctactaaaatgtggaaagaccttggggatgtgacaatcaaataactgaccaatctttttaataagattcttcaaacaaataagatgtctgatgcttggaggaaaaatatgttaatgcctatttacaaaaataagggagatatgcataattgttatgactatagagacattaagcttatgaactagctgtgagagagttattaagtatcgcttgaggagagagaccaatttttttgtaaatcaatttggatttatgtcacatgaaagctatttttttatacgacaattaatgtaacaatatcgagaaaagaataaagacttacatatatgttcatagatcttgaaaaaacatatgatagggtcccaagagaagttttatggtgggctcttaagaagaaaaaaataccattaaaatatgtaaatacaattaaggatatgtatgatgggactaccacatgtgtgaaagcttgtaatgaaacatcaagttattttcttatcacagtagatgtacaccaaggttcggctcttagttcttatctatttgccttagtaatagatgaactaacaaaagatattcaacaggaagtaccgttgtatatgttttttgcagatgatattgtgcttactgataagaccaaagatgatattaatagaaaacttgaactgtggagaaacacattggagcctaaaggattcacgttaagtcgaaataagactgagtatatgaagtgtggattttcgctggtaaaagatggtgatcaagatcccgtgcatctatatggtccagaggtaccaaagaaagatgtttctagataactagaatcaattttgcaaaaaggtggagagattgatggagatgtaaatcatagaatcagagcaggatggatgaaatggcggagtgcatctggatttttgtgtgaccgcaaaatttttcttaagctaaaagaaaatttctatagaacaactgtaagacatgccatgttatatgaaactaaatgttggccaacacatagacagaatgatcataaaatagggatagcagaaatgaggatgttaaggatgatgtgtagttataccaagatgaataagataagaaatgaagatattcgaagaaaggtaatagtagtaccggtgagtgaaaggataaggaaacatagattgaagtggttttggcacgtaatgagacgttccctggatgttcccgtaagaacaaaagtttgttaccaaaaactctgcacaaagagagatagaggtagaccgaaacttacctggaaaaaagtagttaaacaagatttaatggagtgagatataaattgacggatggtgtgtcttaggacgaaatagagaaaaactataagcttgatgaaaagttacactcattgttatctctatgttctagatgatctttttttagcctttttcctcttcatctccccccctcccctctttccctcttcttttcttttcttttctttttcttttatattatttccctttcccttctacttcaccttccactttttttttcaaccttctcgtatctatcattgggtcatctaccaccgaccccaattaacgtggattaaaggtgttggaatgttaatgttgaagttgtataacagccatcctaaggaacctacttctgcaaacattcggttggaaccgagtacagaaaaggagaaagcaaatggaagagataaagtccagcaaccaaatatccacttccaaagtatagtcagtatcaatagtctactgcagataagctcattttcaattatcactctgcactaacaacatacacccactgatgacatttacattaaaaaaaaaaaaacctgcataacatttagtctacctgctttttctaaactttccattgaaacatggaaaagttgaacagaagagggttttccctcttctttgctgttttcttttttaccccccaaattttcagcattatcacctacattttacaaaagaatcagagagataccagtgtgacaacatatatcagattctctgcctgacccttctaccattcttgtcaccaccatctgaaagttggccccatacactctgagatttttccactgcactgcaaccctcaccttcacacccagcaattgtcttcaggatctctgattgtagccatgggcctttttctttcatatgctcaaatccatctgatctcatgacagctgcaacaagtccagacgcaaaaagagccatcatatcaagaatgagaaaagttggaagataaagcatgattgtaatttagtatgcctgaagtcaagaaattttgttttgttctccactagtatttatgcataaactaattttagctgaggagaaacttattttatttttctttcttattttcttctcctacaagtgtttatgcaggatcttattcaaaataggcctatctatacaatctatcttttctgcttggtacctagttgtgtatgccagacagctgtgtttagttagcacaggatgcatgtatctgaactcatttttcttttacattttttagtcacttgttaacaacaaaagttaaacagaaaacatcagtctttctgttagcacgattgccattgctaactaagaaagtaatacaaattaagtatacctgctagattttgagcagcaaattttaggcaaacagctttcaactccgaggcatggcaatgatcagccaaggttaaaatattggctacagaattcacacaaatgtccttacaaagacaagattcacacatcaatctaagcctacccaagccatacttgtcggctgcagctaacaattttgctgtcaatgtctcagaaactggaaaattgctagttgtggttgatgaaaccgcgcccacctcttctgtaagagtatctttgtagataaagtacagcatggcctgtaaaagaggaataatcaggttatccatcctctctagttgtactttaactcttgaactcctataagatcctttttctatcaagaaaaagaaagctaacagaaaaatatacaataacaaaataaatcctgaacaagcttgatgctaccagggaaggaaaataaggaaaggggaaacaaatagtttttaccttaaaaacctttggttctaaatctgttacaataatctcattcttttcctcatctaaaccattaaaaaatttagatcgaaattctggggatctggcagccaacatcaacttatgagcagggaacttttccccggctacatcaaaagtaatatctgaaccttccatattatccaatagtgcaccaaagtgtgatccaatgtcagattctgggatgttaatagagtaaagttgtgggcaatcaattgctgaaaccacaactccaactgtacagttgatttttaaacaatcactcttgaggaaatcagaggtttcaagcaaagaccgtctgaaaaaccgcttgtagcccctataaaagcacaaaaaagagatcaagattttacacatgttgacacaacatctgaacagcatacttttagactgatctagcatcaattttccatataaggagagcctgggagagataaccagggactgaaatcaaaaacaggaacacatcaataaccctttaaaagagagaatattttttttgtttgtgaaaccttcatgcataatatgacaatacaaatctttatataaaccattaaaaaacataagaactggaaagctaactgacctgtataacctttttggtaagctaattacaaggacaagatcaagcatgatcaataaaaagaaaaggaacaaattatcctaacactctttgagatttcgacaaatttcccccaatatgtctcctttttttacccttacaacgatccacttaatggtatgaaaaacattacactaacacctcttgtcacaaacacacatacattacaccgtctacccctataaagggttgctataaacatgaataaagcaagtagtcatgcacaatgtcaagaaacctcagggagtgttagtgtgatttgctcaaagaaaaaaagaagataaatcacgacttccaaaagaaaaaatcacatggagttttagtaaattgatgtacataacaacgacaatttcatagtactcgagaaggaaaacttagatacagttccatatgtgctacttttggtgttgtcctccaataagaaattgaagtttcacttcggtaattcgtctaatagaggtttccactaaataccaatgcaggattcccagagtgaaacttcaattgtaataggagaacaacaccaaaagcacctatcgaactgcatctaaattttgtcctttctctttatattattgagaaaccacggtctactgatcattaaaactttaaactacaaacattcaaaacatagatgcacaatcaagataaaaaaaacatgaaggcgccaaaacagataaagaaaggttattggcagcagagcatggtaccacatgcttcccttgtacttgagcgtgtagggaccggtctccagggagcgatcgaaatggctatgaagcttgtgcttcccctggccgctctggtcaaggagagtgagctcgaagagcgccctgacgtcggtgccttcgctggccaaggcgatgaagacggagacgtaggcggaattgtcctcgggattcttgccgtcggggtagaagtagatcgcccagtggtaacctcccaccgtgaacacgtcgctcgcaatgtgcttccccactcccatccctttcgccagcgaatacccctcgatcacgaacttgtgcgaaccgttcaccgtctgcatcaccgacttcgaactcgtcggcggcgataacgccgctccggacatgcctatccaaatcggaattcaaggttcatgcgatgtggcgacggtgaagggattttcgcgaatctgaggtatttggaatttgaaatttttatttgaaattttgggggagaggagaaaggagaggtggtgtgctgggcggagaacggaataaagacgacgccacggggtgcgtcacggttttcaggtaacgttgacgtcagggggtggggaatatcattgctgccccctgaattggaaattttctagaatgtttgtgcggtatactaacgtggagctggagaagtgttatggatggttaattttataaaattattaatcttttataaaaaatataaaaaatatcttgagttgtgttgatccatttagaatgcaaattattttgaaacagaggaaagaaaacatcaatttattatgtaagaaattaatttttcttttgataaattaaaaattagattaaaagaatgaaattcatgttattttactgacaagttagatatattctctcaaatataattgttttattcatttatatttatagaaaattacaatatcataagagatattcattgaatatcatatatactcatataattttataatttttaataaattttaatcaataagaaaaaatatatttaaaaaattgtgtcttccgttctttttttatgttatctaaaaataattgtgttccacaatgtgtttcaaagaataaaaactgtcttgtggggaaatgaatgtattaaattctcggtagttttaaaatccatagattgatgaatttttttgaatttcacccttcaactttataaaatcacaaacatatttagattaaacacaaagtttataaaaaatcacgagtctctaccacatcagacttgttggtaatgtagcaaattacccgattgcgaatgttattcattcaagttggtagttgacaaaaagattaacattgagagaaaaaatatagaaaatatttgatttaatctttaaatgtgtagaaaatttgacaatttcatcctatcattaaatttgttggaccatttattattaaattataatatgtaatgagtaattttatattaagttgaatatataacataattgtcacatcttttaagtttttacacattcaataactaaataattatttttgtttttaatagactaaattgtaactaattacatatttaaagaacaaagtgattatttagtcttatataagtcactcttacccttgtacaaaatatataaatcaatctcatctacaaaataatttatttagaaagagttggataagaaagactaattaataattatctaaaactagaaaacaaatagttttttaatcaaggaatgtaaataagtcaaattattggtgaattactcaagtttgattaattaaatattcgatcaagcttgtttgtttaatcaaataaacaaactcaagcttgagtttgagtccgataatttaaataagtcaaacttaaactttacaagataaacattagtaacttatgaatagtttgtctatatgatattaaaattagatttaaatactttcatccttggaatagtttcggctctacattttttttttgttttaatcattacaaaatatgtttattttaattttcattaagtttcgtctcaaacaaaaatgtataaccattaagttaattcttacaacaaaaatgagacctaacttgattttgtcattatctaatgttgttaaaatataaatttgagaataacatacaaattatgtttattaattaatattatgtttattattatgtttgttttaagttatgtttgttttccttatttttaaatatttattgtaatgttatatttataatgattaaaaaaaaagaatataaagattaaattatattttagatagagaattgacgaatttgttattgaatgtgtaatatattgacaatttcgttcataaatatttataataacggttgaaaattaacgtaaggataaatttatcaatttttttttattttcaggataaaaatttaaatttttatttttcaaaatacaaattttatcattattttacatatttatcaacaaaattgattatttatcctaaatataaatattggattacaagttcaacttctacattgagtagattgtcacaactcacacgtgacacggccctctaaacgtcttcccccactcactgttccccttcaccaagcccttgccaaggtcttggcgcaagacgttcgcgctcccgaccctctcccgccatacccggcctccgtcaaggatagttacgccgtcgtagccaccgatggccccggcgagtatcccgtcgttgccgaatcaagagcaggagatgacgctctcggcatcactctctcccctggaactgtcgctcacgtaacaaccagagtttcgcttttccacttcttattttccccattccactttcattgaggataaacttctccgtgatgtttaaaatcaacttacgcatatagtttttagagaaattagacgaggatttttctgtataaatcaattacataaatcaattttagtttatgagacaagttgatttccttttcttatttttttttaaggtttatggataggttcatccgagaggaaatgttatttatttaacttaaatatgttttgtcctttaactttagataattatttttttagttttttaaaaaagaatttatttttactggttcctcaaattttttaaaagtcacttttagtccttcttattcttcgtgttaatgatatcacaatttttaataatttctcactgtcaaaatgttttttaatttaatttactggttcctcaaattttttaaaagtcacttttttaatctttcttattcttcgtgatataacaatttgtgataatttgtctctgtcaaaaatgttttttttttaaatttaatttctttaaaaatgataaacatactgaatatgtaaaaaatcttagacaattctacatctatctttttatttttcttctttaataccagcatttgaggttacgtaaatttccaaagtacaatagtttttaagatagtttgcttttttgggtttagattcatttagtttcttttgtatgcagggtacaagctcggctttgtcaacccataaagacagatccagttagaccagaatatcatcgtgcttctgtgatatgggctgacaatgatggaacaggcaatccagggtaagttgaagatgaattgttttgttcttgttttgttctattgcatgtcttttcattttttttttggggggagggggaggtgggtattatgcggagggccagagcactgttgctaatttgatctggtctctttaatgaatgaattttttatcctgtccatgaattgcagttttgttgctgtgagcactggtcatcaggtgagcagccgactacttagtatgaagtcagctaatgccttgttggagtttccagcaacaggcagtgtagtttctgcagggaccgctgtgtaatctatcataatttgtgacctaagacccatggcatgagatgagaatcataagtcatcagactcagcctttgctttgcctggaattaaatcacataaagtaactactgattcttcaggggatgctgaagtcagagtggctattcttacagttagtgatacagttgctacgggtgctggcccagatcgaaggtattggtcttcattttatattatatactggtgaatgcaaacaaggagacatacatagagctggaaatcaggattaaagcatttttttttagcctctttggatttctgttttgaatgacgggagcactttaattgatttttctggtatttgatcaatttgtgtggaaagtttaagacttaagtagtttttgtactttctagataaagcaacttctactaatgaaatcttgcagaagcaggaactccacactgcaccttttttttttttttacctcctgaaactggtactaacaatactctagacaaggttaatgaggtattggtcatattcatcatgttttttcttgcttggcctccaaagttaactaggaatttttgttgttaatcgagtgcatctagtatactcttccaaaccaaagaaattttttctatggatactaaaggaaccaagcaatgtggcatttgttaccactaaagctagatttagctatgctcatctgcaacaggattcatatgtgttgaaatagtcaaattagccaatgttgcattatttggtaaatcatcttcctagttggataatgctgaatggcatctagatacacctctttgaatcattgtttgaaagaggtcacaagtttgatgctaaactaaaaagcgaacttgatattagtcgatgccaaaaggggcattggatgtactgagtgttttgcaacagtctcatagttgaagtgtttggaagataaaaaatctgttttgggcattgctctgttgtagtgtagtagtgttgagtgttctgttgactgcagaaacttatgtacattgtatctggctgaggcttcatattattgatttttcatgcatcctttgtataacacatggggtttatagttttatagtattttatgctgtaataggattatacatttttttgttgtcttatttattcttcattctctgtctttctcaattagctgtttgtgcactgcctaatgaataagttgaggagtttgaaactctttaccaaaatttacccaaatcttcatgcaaggaagtggctatgccccattttttttaaaaatggttgattttattgttaaaatgttctttgatggttttgcgtggttctctttttctttttatgggctgttctaggaaaatatcttattctcccacttgtacaatatcctatcagtaacaaccaatgagaaagtaattatctgttattggatggcagaaaaaatggtttgttaaaacagtttgaaagtctttttagtcataaattaattaaccgagggtgatgacaagaaataacaagtgttcttttagaaataataagaaaacaagaaaattgattataaatgaccaacacctttcgtatgattaaaactctgatggtttattaaaaagaatattaggagggatataaaacgtccatgtcttgtactgttgctagattttagttatttgagtttgaaggtacctattgtattcaatcttcacggttacagtatgattcttttagttaaacagttactattttcagaaaactcaaatcatatagattccaaagcttcttttatttgataatttgtttttattactagttacttaagtttcatccatttacttatggtatacaagtgcccttggctctaaaatggtgctgcattggggctgtatcatgagtagttaaggaaaatcttgcatttattgttgtaactagtacaacctagatccagatatgtaatctgtctttcttctagacttgtatttatcggctaagttatggtccttgatttgttgaaattcagatcattaacatgcatggaaacccaaatgctgttgctgagtgtatggaagctttattgccagcacttaagcatggtctgaagcggctcaggggagacaagagagaaaaacatcctcgtcacgttcctcatgccaaagcagctcctgcagatgtgtgggaacagagttatatgctagccactggtgttggctctgatgtctcttgttcctgttgcaattgaagttaattagtattattttcttctcggctttcgccttcaacattttgcccccgtgttcaaattcgagggatacggaatagtgcagttatcattcaatggtcgaaaagtttatctttatattttatcataaaagtaaaactgtgaagggtgaaaatcccaactaactgtaagatgattgtaaaagacaaataaaaaacacgagaaggagaattgaattatgttttgtaatctttataaaagcaatttgatagatcacatgattttattaaaaaaaaaaaaagaccttgaagaaaaacaaatctatgcaaagaaaggttagtctgggattaaagaatattgtcttaagaccaatgacaacagtgaaaataatttttaagaaaatctttttttttcaaaaaaaataaaattgaacaaattaatctctcctttgattagaaaaacggataaacagatgtttgtaccaaaaaagaaaagcggataaacagatgtaagggagaaaaagattaaaacaataattttatattgtttcaccccacaattcaaatataaatcgagtccttgacagacaatttctattactataattgagagatagaatatttctaatctccactttcgaagtatttttttttcgcaagttttttgacttgaactcgatcattttttaaaataaaaatttctttaggcttcacaagcattttaaagagaaaaaaaatataattattgtcttgtgaatgtagtatgaatgaagaagagatagttgttttaagtctctaactgaagaatatactttgaaagaatgtaaggtagtcagaattggagtttatgcagttttgaagtagtcatcaatttcattctcattgtatatgtttttcttgagagatgtagagggttttcagtcggtgagcattatccttctaagaatgtactagtattgttggacccatctattgagcatttaataattttgaattttgtagctatatttttatattgggaatattgcttttcttatttaattaacagaggattaggattagacttggtagagtttttcattgttgtatgtgataaattgactatttaaaagactatttttgaaagattactatcatgtccacatttgtgttagacagtagctattttaaggacaataattatgaagtgttaagaaaaaaaataagtgtcaattttttttttaatacgattgatattttttttcatttcatcaatagcttaaggatactctataaatcttcattcatttgcatcttcctttgctcctgaatctatagatagattttataagcaacactacgggaaattatactgcagaatttgagtcatttaattgtagatgaatgtattagaaatacaacggatacaatgactcaatgagctcaaattatagttgtgaaacctaacattttttactttattcttttattgaattcatgcatttacacgaaaatgaataaagtgttcttctctttacgtggacaagtagtagtacttgagggcgaaaatctcacagctcttggaagtataattcttcagggtatgatgtcaatgcatttttgccatagtaaaccccaagtcccacaagggccacaaccaagtagattatcaccatccatttcaccaatttcttgcacttgttcttccctgcctccaaatcttcaatgacttcatcatcaacatgatttgatccagaaccgaggctgaaatctattagccttgttttgcttcttgaaacaggcttagtcttaggagcagtaggagttggtgcttcttttgttttacttgagccttcatcagtctttgcttccagagcaccttttgtttcagttttgttggtttcctccttattctgtggtgtctttcgatcatagacttcaccattggtctttgcttcttctgctttaccttcttgggttggcttttgctgttcaaatttttgtgatggggaagttgttaatgtttccttgggcttagtcagtgaaagttctccaaatttgattgatagcttagcaccctcaaacttggcagtcacactgtcggtgtcataatcagaaagaagaggcaattctagattgaaacgacgccatctgttgttagtgatcagtcgttcacccattagccttagggtgggctttgaggtcacttgaaccttcaattgatcccttctaaaacctgtatatggtgataataatattgaaagcagatgaagcgtatttcttttttgattttgcaaatacataaagttagaggctttatttcttttggtaaccacagttattagatttacgacttttcagtgaaataataagatattctcataagttttaggttgatatgatgttttaaaaaaagtttgagattaattcattgcaaaaaagatgtatatatcatgcatgatgatatcatgattttggatagtaactaattataattcattatttagagtaaattcatgcaacctctattttttttcatcctcagatgtgataattctcaatatttttaactgaaacaactctattaattagttatataagattgatttaatggttaaataataacgaaaagaaaagaaagagagaaattgtggattcaaatttttcaattgatattttgaaagaaaaaaaacaataaactaacatttgtaggaaaaaaaataacctatcaattttattctattgttcgactaacaaataattaaggtgagcaaattcggaaatatttatacacatatagaataaattgagtattttctatataaaaaccagattgacgatgaacgttacctataaagacaaaaatatatgaaaacaaaactaatttctttatctgttgcttatgttataatttataacaatgaactaataattaagttgatattattcctctaggttagatttgaaaacttgaaaaaatatttacctggtagcataacattgacaagcctttcatttctatcccattcatacaatggtacaaagtcttcgtagacacgatcagatgctgctggctgtgtccttgaacccatttgattttatccttgatttgtttctcttttgcttttgcgtttgatgtatatttgcttcttggtattgaattgcttctagggcttctttttatactcataattgatgaggcaattaggaccattttgcacgcaaaatgtagtagcattttgtttgctttcgtagtttcttttcgtacgttcaaacactattagtttgtgtggcgcaagaaaaataatatgctttagtaacgagaggaggtgaccccgttctttggtgatgctaaaacccaaaagcaaaaatttgttccgagtgcaaatcttttaccgacaaataaaaaattacagcttaagcttttttccatctctcgatatactattagctgcttcggaggttttcaattcgctcgtgtaattcgtgtctacatgtctcactttctaatttctatatcagtgcttcacaagataaaaaaatgggttaactacattattagtttttagtcttttcttttcttagagtcatactataattgtatttgtctttaattattatatttatattaaaatatttaagattgtacgataaatttagaatatcacatgactttaaaattttaaaagttagaaattaatgaaattcagaaatgtattacacgatgtaaaagagagaaaagttagattatctatgtcaaagtttaatgttttagttggtggactttggagagagaaaaatttaaagcaacataattgattctgtttgtgaagatttttaattataaaatgagattttaggcaaaagaaaagtgataacatgcatgtaggattaaattcacttaattttaaaaatagaatgatttaatttacttgaaaaaattaaggaattaaaatcatgaattgtaaatagattaaataaaaatgataaaaaaagtattccaatgtaagacatttttcttcaagagattaaatattcattatattaaagattcatgttttaaaactttggtagcagcctatgaatgaagcatcgatatcgataagacgtttttgataagttctcatacgggacgtcgatatgttatttcaaaaatactaatattttgatatgttccttataagtcataatattaaataatatttttttatatagaatacattttatattaataaaatataataaaagaaaaattataaatacaaataataaattatccatacaaaattaataaatactttaagtaatatgtgaatatggaagaaaaacataatttattctatttatggcacttttttttatttataaaaatatcatttgaaaatatttaactaaactaatatgtaaaatgaaatatcttcaaaatatcggtaatagcaatgctagtaaaatattaaaggtgatagaagtaaatgtgaaaataataataagggtgattactctgatgtaagtagtcgtaggactcaaatcctttgcatctgttaatgttatgccagtaaattgcagtactgattactcggacgaagaatttaaacaatttttattcaaataaatcatcgtgtttttttttcttttcaaattttctcaaaaagaaagaaagaattacatagggaaaactggtctattattttgaatccaattgttcaatgatcagaccagttgttttactcctttattgaattcaatcatgcgttgacatgcatgaatattacgcatatatatatatatatgggaattaaaattccttgaattgctgaagttctgatcctcccttatgagatgacatgaatgcagcatttttgacatacaaccccagcaccataaccaataagatgaccacaaaaatgttcatccatatctttggcctcttaattagcttttcacacttgttaccaccaaacccttgcttaacaacatcccggtcttctactgatctcaaactcacagtgaaatctaaaacccttgttttcagtctctgggttatctttggttttgatgaggttgttgttgttgttcctaattcttttgctgtctctggcaccccattagtcctcaccttcttttcagcaaccacttcttctgttttgttatccttttctttgtcatcatcactaattggctcattctctttctttggtgacgactcttctgttttgttctcttctttctcatcactagttattggttctttctctttctgtagtgactcttgcttatgaacctgatcttgttgttgtgatggttctttctctttctgaggcattgttggagcttcctgtggctgtgacctagcagcaggggtgatgagcttttgaaacttgatgcttaggatcccaccctcaaacttagcactcacatcattggtgtcacaatacgggggaatggggaattctctagaaaaacgacgccgcttgttctcaacgatctgtcgttcaccattgatccttagcacaggagttgaagttacttgaacccttagttgttcctttgtgaatcctgttcatgttcaaagtatatatgtatgaaaaatgtttgatgaacatgcatcatactattttacacacagagagacttaaaaatgaaaaattataaatatgataaagtttatgatagtgattgaaagaaagaaatgaaaaatattgatcaaatatttaaaatagatggatgtatgtttatcgttacttaatatatatacatagaacaaaatgtgacgttaattgtgagaaaacatgattatttttaatcagaaaaataaaatactatatgatttaaagtttaaattaattagcatgcattgcttggtgtaaaagtttgcatatatatatatatatatatatatatcattattcaatgaaaaattatatggttagtatgatttttaagatatacaatttgaatttaattaataatcatacattgataatttataataattatataatgttattcaatcataaataataattaatatatgacttttaaaagaattattaagaaactcaacaaacgtattatatatatgttaaattataattgaatgataatttaaaattattttatattatcagtgcttaatctattttttatatatttattttaaaaattaacaaacttaatatatattgaataataatgtaaactatttacaatatatatatatatatatatatatattattttattctagggttcatgatgaattattttttctcaaaaaaataaaatttatgaatacgaattagaccactgagttgagaaggcagttgtttgcttatataataattaaatggagtattactataggctaaatttcacggatatatattgggtaaaattaaagaagttaattacctggaagcattacaatgagcgtgacacttccttcatcttcagaccattcgaaaaagggatcaaaatcttggtaatcaaatttagctgctgattgtgcctgtgccatagttacttttacttgttgatcttttgcttttgacttctcttcttgtctccgttgttggagaatgaaagctctggcagtgtgcatttatatgcacattgataggagattatatattatgcattttgcacgcaaattctagttcctgttaatttctctttttgctttattactttcttttcgtgcaaacattgtgtctctgttattagggtgctgattcacgaaaaattatatgctttggtctcgtagaggaggtaactttgtgttttggcgatgctaaaacctccacgtgattcctgactacaaatattgattggacaaaagttaaggattttttttcttcttttattaaagaaagatttgatttttttttaaaatactatattttaagtaaccgacttcttcaaaagaaatggttacatatatatagtatgttatatctaaaactttataaagaagacaacataaatatatataagttaattattggttgacatgttgattggttaactatgattgttaatcctttagtaaattggtatatttaatttgttaacaatgataataattgaatcgttattaataatttaagtgtgcgtcgtcgagtgcaagattgatttcatacgtaaaagaaattttttaagaaagaataataataatactcaataaaataagattttgttctccctcaaccaaatcatgtcgttatatatatatatggaagtctacacaagaagttttctccctaaatgtaaacaaaggaatcccaaaagaggttgtgtggtgtgttcctacctcacctttcttcaaattaaatacagatgacagctctttcagtaatccgggtcctttgggttttggtggtggttgtgtataactcataaataaatatcgaaaagatttaaactaataagttgttgagcaaatcatattagtgagtattattggaaacttacttgggcaatggattcaaggtttctacagattgatgcatcacctattatattttctcataattaaataagtttatatagggtattcataaactgatctaatttaatgtggataaaaaaaatcaaaaatcaaataaaccaaaatcaaatggattaaaaaattgaaaaatgaaattttttactgaatcatatctaatttcagatttgaattgaaaaatcgatcaaattcaatccaaattgaatttgtacatatgtatatatttttattcataaatttatagtattgcttatagtcttatttttatttcctatatattttaaaattatcatataacttataattatttatgaaaattacatttagttaaagaaatttttgtactacttaagatgggtaaatatattagatttaaatatgtttttagtcctttaaatttaagtaatattttttagtcattaaaaataatttatttttattagtccctcaaatttttgaaaactacttttaagtcctctttatttaatgtgttgatagtttcacaatttgtaattattttatcctcaaaatttatttatttttttaaaaaaataatttcgaatgattttaaactggcaaaatattttacttgtatgatttgttgactatttttttacatattttaattgttttaaagaagaaaaataaaaaatatagatatagaattatcatgatttatttacatattatgacatttttaaattgtcacaaatcaattatgaagaaattaaagtaataaaaaaaatttgacagtgacaaatcttatgttaccattaacttaaagaatgagaaggacaaaaagtaaatttttcaaaaatttaaaaaactaataaaaataaattcttttttgaaagactaaaaaaataattgtccaaatttaaagaactaaaaatatatttaagtcaatatattattattaattatataatgatatactaatctatgaatgaaatatttaatattttaaattatttttttattatatatatatatatatatcctatttcttatttaatattttctaaaaataagagtaagaataaaactgaaaatcaatataatccaaattattttaaattaaattgaattaaaattttaaactaaattgaatggatgttaaatcaacaaatcaaaataattatattgaataatttttttttcaaaaccaattaaatcgagttgacaaacactcttgttcacatatcaagagaaataaacgaaaagaaagtttcttaataatattaccagagcctttggaacctatccacttcttttttattttctatttttacttttattttttaattacaaaattgtcactgttttaagtttttcttctaaagatttatacagaaaaaaaggattgatttgagtgaatttcctgtgcaaataccccaatagggtgtcaactgatttagtctactttataaattattattataataaaacttcataaattataaataaactgaattgagcctggaagcattagaattagggtttcactgtcgttctgactatctctatcagatagtggtagaaaatcttcattgacagattctggtggtggtggtggtggtggtggtggtggtggtggtggtggtggtggtggtggtggtggtggtggtggtggtggtggtggtggtggtagcgacggtggttgttgtcgtcgtggtcgtggtggtggtggttgtacatttatcttttcatccgacattttttcacctgacctggtttctcctttttctcttatgttcagtgttaaaattgtctattatcttggagaatgaaatctcaggttatgttaattatatacatgcacatcgatgactacccgtgttttcttcaaacctagctcttccttttcgtgcaaagattgacttaactatgttaaggactttctcggttgtcctatgctagataaatagaaaataacaacacattgtctctccaaagaatactttacttgcatgctaggcaatgtgagcttctttctctctaaagaatacatttaatcaaattctttaatgtgtgtaaattaagataaagacatcagattgttccttggtgagggtttgcattattccttatatattaaggttgcacggacaagacaacaacttcatatatatttgttctttaatataaatattagccagtggcgaggcaacattgaaataataacatccttatcaatacttgaaaatgtatgtggtctgtcatatagaaaataagtgtaatttctaaataagtatataatttatttagtccttaaattttatatttttaattttttaattttttattatctattttgatcctttaaattttttcttgtccttaaaagaactaaaaaatttgaaaaaaatctaataaaaaattgaaagattaaaagtaaaaatcttaataaaattaggaattaaaaaataataaacttaggaatatatcactctaggaaatgcatgactcatttttgttgttgttgttattgtgtctcgatcttcctaatggtttctaattcctaattattattgagctatgtgagtaaaaaataatttcatatacaaaagaagtatagtttatgccaagatttgcggacaacaacaaaagcctaatctcacaactcactagttgaagtcagatacatgaatcaaatcatgctaccactactacaagcgatacctacgacgacagttgtaaaccccatacgacgacagttgtacaaatgtcattattgcgcatgtcgttgaaaatgagaactttcgatgacggttctaaaaaaccgtattcgttgataatttttttatttaacacctacaaagacagtttttaagagataaccgtctttgtatgttgatatacaaagacgatttttccttaaaaaccgtattgtttctgttttaaatatttttttgttttttttttatttaacacatacaaagaaggtttttaaaagataatcgtttttgtatgttgacatacaaaaacgatttttaagagataaccgtctttgtatatcaacatacaaagatgatttttccttaaaaatcgtatttatttccatttcaatttttttctttttttttatttaaaacctacaaagacgatttttaagagatacctgtctttgtatgtcaacatatcaaatatgtcaacatacaaagacggttatctcttaaaaatcatctttgtttcaattttaatttcttttttttatttatttaacacctacctacttttgaagttgggtatacccaacttgattaaagatcagatcttcggagatactatttattatgagattccactttaacaacttccccagtgcctttctttttctccttcttctcattttcactagactaaaacccatgcaaacttacacggaaaattgagaaaaataaaataaaatcctcttgttgtttctgatggttctgtcatgaaaatgaaggtggagaagatgttggcccattgctgatgcctgcagaagctttgctgctgatgttgatatagaggatttggggttcaactctttttggagaaagggagagagcaaggacttaaagcttagtaggttgcctcagtaagacaaagatcacaatagtattagatttcctttgttttttatggaaatcaagcctattgtgtcctttggcttctgagaaatactgttggtacagtcctactagtctagaggagcttcagagaatattagtgctaaaccgagtaaatggaacccggatgaagcttgttgttagtaatacaggtatgggatattacaaagataatgaagtctatgatatgtgtacattgatctaaggggcatttccgagctctcaaaggtcagaaaggatcgaaaagggattgaaactggagcagcagtgacaatatctaaagccattgaagcactaaaggaagagagcaaacgtgactttctctcagattatgtaatgatactcgaaaagattgctgaccatatgaacaaagttgcctcagccagtgttggtggcaatctagtgatgcccccagtatgaacccattggtgagccagtcatcaaatctggtgctgcactacaagcttcaggtttgtttagctcggagttttggattaagatattgacagctccttttctttgcatctccattgaaattattctgaagaccaaagataaaaagaggtccactcacctgtagcttggcttggctcaaagctgctcatgtcaccggttaccagctagctaatattgacataaatgtgattcacaatctctcactttctactttagagttgactaggcttcttttgtcagacactgatattttatcctgttttgatgcctttcaattatggtttttcatatttagttgttttaatttcatatcagtggcaagtatatatttatcaatatatttcaccaagtatcattgatatttatcaataaatcatatgtaggtgaggctatatttgttgatgacattcaaaaaaaaactatgtaccccattgttcataggttctttgctgtacgaagataaaagagagagatattgtacgcagtcttatccttgtatatgtaaaaagactgtttccgaattttaactcataaccaacaagtcatcaatgcacaactttaccactgtatctgagttcgttctcttattgatgacattccataaccaaaaaattgcctacatggaacatatatctatagttcaaaacctttagcaagggtaaagagtataaaactcagccctgaattggaactggatggagtgagggatatcatttcaagtaaagacatacccaatggggggcagaacattggatcaaagactagctttggtgaagaacctttatttgctgaagagatagctagatgtgtcggtgatcgtctggcctttgtgggcttctgtttcatttgtttggagactgataaaatgaaatgcttccagtttagtcaccaagtatcttctataggttgcagatactcagaaaattgcagatattgctgcaaacgctgagtcttgaaaatcttgaaccacctattctaactgtggaagatgccgttaaaagatctatcatttttaaattacctccttttctctccccaattcaagttggtgatgtgttaaaaggaatggctaaagcagatcgcaagattctttctgctgaggtacatgtaacatatccattgtttcctccttcacatctttgtggccatctctactttggtttctgatgtgatgtttaagtttgtttctgaataatgagtgttgatgagattatatagataaaacgtggtcattgtcatcatgtatcaaattcaatgttaaatacagttgaaacttgtgtctcaactctcaatactatttctacatggagactcaaactacacttgctgtacttgatgaagacaattgcattgtggtttacatttcaagtcaatctcctgagtatgttcattctaacgtagcaagatggctaggtattcctgaaaataatgttcgtgtcattacaagaagggttggtggaggttttggtggaaaggtcgtgagagctacgggagtaagtttttagtttactatgcttttgacaatatttcttctttattattagatctgttatcacttcttgaatatgactaattaacatgtagagtctaggcatgaatattcggactttctgtagtttgaagaattcactgttaaattaaaaaattatttataatttttaaaagaaaattgaaaaataactaatttttatcaatttttttaaaaaaattatacgactttaaagtaataaaaaattttacaattttgtagtaatattttgataaatttgttttttcaatttttttacaaaattgtaaatagttttttttaatttaattatttaataaataaaatatatttttacttttttttgttgatttaattaaaaaatttatatgattttacttattatttatttaatataatttttatatattttattaaatttaacatttttatttaaaaattgaaaaataaataaatttttcattttaaataaaaaattatacgacttcaaagtcgtaatttttttataattttgaaatcataaattaaaaaaaataattgaagtcttaaattattttacaatttctttaaacaaaattaaaagtgataactaatatttcgacttctaattccaattcagaagtctttaacactcgttataatttaccttcttttcataatttatttgaaatgctcctatttgattgtttcagacttaaagtctattcccaaatgataattaaaagaaaaaacgcagcctattggtgatttcccttcagggtgtatctgaatccaaagacagatctgataatggccggtggaaggcaccccatgaagataacttgagatattgatcaatgcagggatatatgttgattttagtccaataataccacgcaacatgattggtgcacttaaaaagtatgattggggtgctctctcttctgatataaagctatgcaaaacaaaccatcctagtagagctgcaatgagagcccctggggatgcggaaggatcatacattgctgaagctataatagaaaaggttgcagccacactttcaatggatgttgattctgtaaggagcattaatcttcacacatacacaagtctcgaggcattctacaaggactcttgtggtgagcctcacgcacgagtatactatgcctttaatatggagtaagttaaatgtttctgcaaactatgaaatgagagttgaattggtgaaagagtttaataggattaacacttggaagaaaaggggaatttctcgagtgccagtgttgtatgaggtgaatgtaaaaactactccaggaaaagtgagtattttttcagatgggtctgttgttgttgaagttggaggaattgaattgggccagggtctttggataaagttgttgaaacagatgggtgcatttgcacttggtgcagtgcaatgtgatcgaactgatagtgttttggacaaagtaagggttgtgcaaactgatattgtgagcttgattgaagcctctcaaggaaaaactacaggagaaaatgggttctgtcaactgggtgaagcttattcagcaggttgaatctatattttaaacatgagtaaatattgtattcattgatgttctaattgacttttaattcaattattcaatcataagtttagtggcggagccggcttgtaattttaggtagtgccaaattttaagtagtgtcaaattttatttagatagtaccaaattttatttttaatactaattaattatataagtatatataattattaaaaaaaaaattcatcccttgatataactgtaaatttaatttttttagctggtgtcaaagcccttgctggccctaaggtggctccgccactgcataagttattatatttgataaatttgttgacttaaataataattttttaaaaatcacgtgtatcatgattttcaattgattaacaatgcataaaaattaaacttttaaaatattgatgtgtatcttattttcttttataattttgtaaagagatgtctcactacaattttcttttatttttaattttataaaattattattcttttttatctatttattaatttttcttattttgtgtaaaataatattaaataacctttattttgacaaaaaaatatattttaatcaatcattatgatggattgtattattgctaccttttcatcacttattttgctctaatatttttaataaatattattttaatttttaatctaatattaatagtatttttgttcattcatttaataaatttatttttataaaattagtatttatttatttatttttcttaatttatataaaataacgaaaaacaacacttattttatgaaaaagaaattatatttataaattataattaatcattatagtcagtcatatcattatcattgctaccttcccatcactgatttcttatcttacctcccctgagccctgccgcactaatcgctcttttctcgttgaattttgtgcctggctctttggttttgccttcttcttcgttaaaacttacaaccacaagtccacccatcttctctatccttatcttttgccattttctatctcttccaataacaaacggacgaaaaactgacctttcacaccaccctgcagtctgcatctaaaaaagtcaaacacaatttttttttttgcaagaaataaagagataatgaataaaaaaatactagttagaaataaataaagtgacacctatcattagagagatggaggaaagatttttagggaagaggattcaagtcccaatactattttgtttagaaattttaaatgagttggatgattaaaaaaaaaaaagtttgtcgaatttgatcttctctattcttctgataaagttaatattttaataagttaaaatttgttgataaaaaaaattaacatttgcatggagcagcatgcaaaggtgcgtgagaaagtgcatatatagagtaaggaatcaataaagtatttgttgaattaggtggttgaggtgacagtgacagaatgaattggaaattatgataccaattccacatgcgtttttaaaaaattaacgttgtgcccatgtcgatcgagaacagttgactattgtgatgtgaagaaagatctgtaaggaacgccgactcgcacacattaattatatatgagagtttaaagttttcttctgttgctgatcaaaactgatagaaataacacttgctgagctatggaactggagaagacaccaccgacaagtttggtttttggtgttaatggtgagaggtttgaactctcccacgttgacccttcaaccactttgctccaattcttacgcactcgtactcgtttcaagagtgtcaagctcggttgtggtgaaggtatatactataagtttgtgttcaaccatttatctttttttgtttttctatttcaataagcttggtatttacgatatagattcatcttctttctccttccttctctgtaagattaatcgtggttccacttggtgaaatcctgaataaattttgatggtcttggaatgattttccagttccaggtcaaacgggttagttcaaagctgttgtgaccttgtaggatgctgcttcaatttttgcacttaattgtactccctttatgcttactgtcactttaaattgtccaataccccttttctggcccttttaagaagcagatacaatggaagaattataagtcagtatattgattaggctgatcataagcatgtaatgtacttctgtcaaacaaacaaaaaaacatgtactgtacttctgtaaaaaaaaaaaaaaaaaaaaaaaacatgtactgtaccggttcatattattcttgagctatatcaataattttcattttcatttatatatgataagttcttccaaaagtaactcttgatagtgttaatgttctccataactttttgtatatattaaatttccgcaatgcaacccataaacattttaatatcatttcaatcataaagaatctaactaagttggttgaattttggctaaacagtatgcgtggataaaagtactaaataattttgaaactataagaaattgtaaacttgagctattcaatgaaaacttttaatctaatgaatcgttgagagagagagagagagagagagaaagagagagaattattgaatggagtaaatctgccaagtgtttttcttggaataatttgatctgcaccctatatatttaggcgggggaattcatcttatttttctgatgctcaaatcatgaagatgaaggaggtgttttagtagtccaatttttattttatttttccaacttggtacttcatgtttagacatggttggttggtttcagggggttgtggcgcttgtgtagttttaatctccaaatacgatcctgtgcttgaccaagttgaggattttacagcaagctcttgtctcacactactttgcagcatacatggctgttcaataacaactagtgaaggcattggaaattctaaagaaggattccacccaatacatgaaagattttcaggattccatgccactcagtgtggcttttgtactcctggaatgtgtgtttccctctttggaactcttgtcaatgctgaaaagattacttgtccagagccacctgctgggttctcaaaagtaactgttgctgaggctgaaaaggcaattgcagggaatctttgtcgctgtactgggtatcgaccgattgctgatgtctgcaaaagctttgcagctgatgttgatatggaggatttggggttcaactctttctggagaaagggagacagcaaggacttaaaggttagtaggttgcctcaatatgaccgtaataaaatgaatagtagatttccgttgtttttgaaggaaatcaagcatgatgtgttcttggcttctgagaaacacagttggcacagacctattagtctaatggagcttcagagcttattgaaattaaaccatgataatggaacccggataaaaattgttgttagtaatacaggtatgggatattacaaagaaaaggaagcctatgataagtacattgatctaaggggaatttctgagctttcaaagatcagaaaggatcaaacagggattgaaattggagcagcagtgacaatatctaaagctattgaagcactgaaggaagagagcagaagtgacttcctttcagattatgtgatgatacttgaaaagattgctgaccatatgagcaaagttgcctcaggatatattcggaacacagccagtgtaggtggaaatttagttatggcacagaagaataattttccctcagatattgctacaatacttcttgctgtagatgcaatggttcacataatgaccggtacacaatttgagtggctaacattagaggaatttctcgaaagaccgccattaggtttggaaagtgtgcttttgagcattaaaattcctagtttggaactcaatataagtgaatcatcagaaccaagaagtagattcctctttgaaacttaccgagcttctcctcgaccccttggaaatgccctttcttacttaaattctgctttcctggttaaggtgtctcaatgcaaggattctggtggaactgtgattgacacttgtaggttgtcttttggtgcttatgggagtaagcatgcaatcagagcaaaaaatgttgaggagtttttagctggaaagcttttaagtgctagcattctatacgatgctgtcatcttggttacagccactattgtacctgaagatgatacctcaaaaaccacttaccgttcaagtttggcagctggttttatttttcagttctttaacccacttcttgacgctcccgcaataaacaatggttattttaatggacatattaatcttccttatgctaaggattttgagttaatagagaaccagaagcaggttcgttatgacaaagtttcaactttactgtcatctggtaagcaaatccttgaagcaggctgtgactatcatcctgttggtgagccaatcatgaaatctggagctgcactacaagcttcaggtttgttttgtatcattgagttttgaattgattgactgccttctgtttttgcatttctataattgtttcaaagtataaacttaaatatttacatgaaaaaaattggtacttttttgtattaaattccatttgctagaaagtgagtccttgtgcaattttaggcttgtaagcttgtgatctggtggtatacagttgtatagatttcaccctctctagatcctacaatgcttgcagaattgtgtgttggactgcccatcattattcacttccactgaatatgagacatcaatctctttgtcaggttcataaaaatatgtctctctttctccttagaagcttgtagcaacaagcaagtaagtgtgtcagatttttccctctctaaaagcctcccccttttcccttcctgtgattgtgttaggtatggctcatactatgccgtcagcagatatgcacgagggctgggggagtctccccggcgggggcaagggcgcagtgcccccggaacttttttcgaggcctagtactgttgttggtctcgtgttttattatttgtaatttaggcttgggcccatgaatagctacggtgctagggtttctatgcctatatatttctttgtaatctgagtgcaattgtacgagtgtgtgaggaaatatagtgaatagctggacgtagctcatattgggtgaaccagagtaaattctgtatgttgttttcttcttccccttctctctttctcctatcttgattgttgtgtgattgcttggtacccaacaatgatctcttgctttggagtagtctggtattttttttggttgaatccggggtatccctcggccgagagccaaggactaatccctcaaggtacatagatccatttaagggtctaacctctcccaacagatgtttttccatacacgtggaccagggatcgaacacctgaccacatgcttaaaagacaatattatcttccaaccatgtcacaccatgttggtatattcatttagtagcattttataaccaattgctacgtagcagaaggcaaaacccctatgttcataaaaaacttgttccccatgctcttggttctgatgaattgcgtatccatattttgcatcttgtctctggttaccttataactattgtcaagataactatgctaaaaagtccactttgtactgcaggccatagactagattttgtgtgtgaaagatttattttatcctgttttggtgcctgtcaattataacttttcatgtttaattttttaaatttttgttcagtaacaagtacatatttatgaataatcatcatgtataggtgaggttgtgtttgtggatgacattccatcaccatcaaattgcttacatggagcatatatttatagtgcaaaacctttagcaagggttaggagtataaaactcacgcctgaattgcaattggatggatcgagggatatcatttcaagtaaagacattcccaatggtggggaaaacgttggatctaagagtatatttggggttgaacctctctttgctgaagagatagccagatgtgttggtgaacgactagcctttgtggtgagttcttatatccctcattttgatccaataaagtatgagcttctttttcatttctttggagattgatatgtgaaatactaccatcttagtcaccggataccttctttaggttgcagatactcagaaacttgcagatatggctgcaaactcagctgttgttgattatgataccgaaaatcttgaaccacctattctatccgttgaagatgctgttgaaagatctagcttttttgaagttcctccttttctttatccaaaacatgttggtgatatatcaaaaggaatggctgaagcggatcacaagattctttctgctgaggtacattatttactttgcttcccctcttcctctcattccatacctttgtacaccttggtttctgatgcaatgtttaagtttgctcctgaataattaatgtttcattggttatgctgaacaaatattcatttgttatctatcaaattcaatgttaaatgcagttgaaacttgggtctcaatactatttctatatggagacacaaactgcacttgctgttccagatgaagacaattgcattacagtttactcctcaaaccaatgccctgagtttgcgcattctactatagcaagatgcctaggaattcctgaaaataatgttcgtgtaattacaagaagggttgggggtggttttggtggaaaggccataaaagcagtatctgtaagtatttagttatgctttaatattttgaaaatctaatatattactcatcgctatcactttttttttcaatgtagagggtagatacgaagcttcaaattttctgtagtttggagaagtcaccgataatctgaatttttttttttcttatcaccatatttctgtagacatattagtatatgctcttattagacaaatttctgaaactgtaaaagaagtttactccagtggattataaatagaagcttatgtcatgtcacatcatcttgaaatgtccatataagtagcttctttccattatatgttgcatgatataattgtcaacggcaagcctggaattagaataaaatggttttgtacttctgtctttttatttccttcttccttcaaaatattatgtgctgtatcttctccctttttctaacccatcctgtaagattgcagaaaagattcagtagtagagaagttatatatgaaaattacatatgcatgcatgtgtctaactgtctataatactaacaattggatcatgcaggttgccacatcatgtgcattagcagcacagaaattacagcgcccagttaggatgtatctaaatcgaaagacagatatgataatggccggaggaaggcatcccatgaagataacttacagtgttgggtttaggaatgatggtaaaattactgcactagaacttcagatattggtcaatgcaggaatatatgtggatgtaagtgcaattatgccaaacgctatagcttacgcacttaaaaagtacgactggggtgcactatcttttgatataaagttatgcagaacaaatcatccaagtagatctgcaatgaggggccctggggaggttcagggatcatttatagctgaagctattatagaaaatgttgcagctacacttttaatggatgtagattctgtcagaagcgttaatcttcacacacacaaaagtcttcagtcattctatgagcactatcatggtgaaccttatgagtatactttgccttcaatatggagtaagttggctgtttctgcaaactatgaccagagaaataaattggtgcaagagttcaacaggattaacatctggaagaaaaggggaatttctcgagtaccagttgtgattcaactgactctaagaccaactcctggaaaagtaagtatttttttagatgggtctgtggttgttgaagttggaggaattgaattgggtcaaggtctttggacaaaggtgaaacagatggctgcatatggtctcggtgctattcaatgtgatggaactgaaggtcttttggacaaagtacgggttgtgcaatctgatacggtgagcttgactcaaggaggcttcactgctgggagcactacatcagagtcaagctgcgaagcagttaggctttgctgtaatatcttggtagagaggctaaagcctcttaaggaaaagctgcaggaggaaatgggctctatcaagtgggagacccttattcttcaggtagctactataaataaagtaaaagagctcaattttgaacattgataaattttcctcttaaagagttatcttcatgattgttgtgggaggaagttcccagaagataaaaccagttctcttcataacatgaagcaagtggcaacttaactgttttctctctttatgatccatgtggacagactatttatgattgaatttcactactgaccactgaaaggtttacaaacttgtgtttttcaattcacattgatgcatgtatattattattagtatttgtaattgtgcatgagatgtattgcctcaagcttttcctgttaaggtcttggagtatgtagtgcggaagatggcacactggcaattagcgttctcacaatttattggttcataattactataattaggaaaatattcagggaatttcatgtgcaaatggaattggtagagaatttcttcttattttcctagcccacaagcatttatatttaatcaccatgttgctgacaatttattaacgtacaggcacacatgcaagctgtgaacttatcagcatcttcattgtatgcacccagtattaactctctgagttaccttaattatggtgctgcagtaagtgaggtaggtcggttttattttttgatttatatgcacatctcaaatcaaaatggtattttctctagttctttgataattacttctattgaatgttaattgctaatgtatattttcacacaaaccatgttactgaggtaattgagccaactttttttataccgatattctaaatattggaaattatttctcaggtggaaatagatcttctgaatggagaaaccagatttttgcaaacagatattatttatgattgtggacagagtctaaaccctgctgtggatttaggacaggtaagccaactacatatttgctaagcaagctcagcccataccaaggaataacataagagttgggtccaaaaatagtttttatttacacaacttctcacatcaagaccctctgggagtaaaaaaggacattgaactggcacactattccctatgccaaaaattaaatttaatagtaaaagtggaaaacacaataatcaactcctaattggaggtcctagaatgtttatggtctcttactacttacaactattcagttatttcagtatgaatatttatccttcttaacaatacaattgtatcctgcagattgaaggagcctttgtccaggggttaggatttttcatgcttgaagaatatgaaacaaatcttgatggtttagtgttgcaagacggcacttggaactacaaaatccctacgttagacactatacctaaacagtttaatgttcaagtcctcaacagtgggcaccaccagcaacgtgttctctcttcaaaaggtatgagcaaggaggggagttatcaaaaacctgtttgtaaaattggtcggtcttatttttattttttttctcatgaatgcacctcacttatacatgaaatgagtagttttgtgcactctgtttcattgattcattatagtttattctaacagttcaatttcaaaatctagggatgataaagacataaatatttgttaacaatatcttttgtagtggaaagtaactaattaaataatatacgagcttgggtacgagatgcatgtgatacctctggaacagaaaatttaaaaaaaaaaaaaaaaaaaaaagttccatatcaagcctggggatggaagtggatgcaacaaataatgattaattcaatttcatctgcataatagtttggtaaaataaataatcgtgtttgtaacttgaaagtactccctctcactatccctaacaaaaataattaatttagttaatcatattaaatttatcaattatttatactatcattttaaaattatattttttatttttttattcacttaattatttttcattaatatttgaagtgagaataattaagtaaaaatatgtaaaaaaataattaatgcatctaaaaattaataaatgatcttacaaaaaaggataaataaatttctgaaaatgttcttataattaaagacaaaaatagtaatttgcaataataaaaaggtatttaaaccttttatttaagactcttaataagattgagaaagcttcacttattacagtttgaaaatctcaaatgaaaaaaaaaatgatatttgttgctgcagcttctggcgagccgccattacttcttgcagcttccattcactgtgccacaagagcagctgtaaaagaagcaaggaaacagcttctttcatggagcaaccaagatgaagaagattcaacatttcagttgggggtccctgcaaccatgcctgtggtcaaggaactctgtggactggacattgtagaaagatacttgaaatgggaaatgggaaggacataatggtgctcactatcctaaataagttggaagaatgatcttattctatccaattttcattccttttggtaaaataaataagtggagtttttcttttattttatttcacataatgatcatgctagtggaatttaaaaaaaaaaaaaatatgtttacaataagaaacacaagctggttcagctgggtagtttctgcagcaaggaaaaggactagctggacacttatgttctccagttatgtataagtaaaagttaaaagtgtcttacatcttgcttgaatgctctaacatccacataagcatgctttaattattaaccaaaccgttttaagaaatgaaattgctcgttataaaaattggtatacgatttttatttggtgtgcggctgaattcattcatatcagcaattcaatttttataagataagtttttgttaaccaaattaaattaggaagtttgcagctatatattttaattaaactgcacctcttgcagttctaaaatactctctggaagatctaggtaattaataagtgctagtaaaaattcatgactgcagagcatttcgatcggcccttaagatgtttttttaaatgatttttttttagaacaaacttagtttagtaacttgacaacaatgatattaatatatctactctttttttttgttagcgacaaggttagaatctaaagtcttgtgttttttccagcacgtcatgtatcttatctcttcctttcctttctatctctttaattgtaaaatttattatagaaaagtattatgaaagtagaattcttctaattcttatattacaccttaactctaaaatgttgcaccttcgatgcccttcttgattctttttataagactttttctaaattatttactacaattcacttaataataaataataatatttaaaagagtatttcaataaacatttttaaaaatagtttatcatttctttcaggaacattatttataagaaagatatggtcagtttctaaatacaaacactgccgacagagtttcatactgtaagttgttattttgtaagtactaatttttttcaagataaaattaatccatattaatttgaatatgatgccgcatatgcatgatatgaaatataagcaatgtgtcaaatagagtaagagacacgtgtttacaagatgaatttcctccataaataatatgccaggtgcatgcatgacaccgttgtcccttgtcccataaaatgatgataggtcccataaaatgatgatagactcgtgtttcctaaaataaagggggaaagtaaaaggcacattgctttaaatttgatttgataaatgaaaaatgattggtttgtaaagtcaggacaatacaaaaaaatttcttttattatattcttaagatgaatataaaaagaataataaatggttatataaaattttagttgcatactttttattctcaggatgttttcttatcaatgattcataattttttctattaaataacttattttcacttatataaatacaataatcaataaaacattatacgactacatgaatacttttgattaaaaaagtacatactcttcttgtatttcggatttatatgaattattaagctagcatcacgagatgacttgtgtacccgctgaaacagaaagcaacatttgcaaacaaaaattgtgaatggcgagaagacatataagcatgtcactatcagcgtacaatctaacagtggacacaataaatttgtaggcaaatgttcagtagtttaataaagaggtattcaattaacagggacacaaacacaataaatttgtaacaacttaaaatgttcagtaaatttttggtttcattacattgttaattctttaaatttaaattaagcatttgtttttttagttgattttttacttaatataaaaccctcaatattttttatatttttttaacttcttacaaacatgatgtaggcatagacaaaaatgttaggatacaatcaaaattacaacatatgaaatgtttcccaaactaagggagaaaaaataaagttagtttggtattacgatcctgcggaccattgtattagatgatgcaatatcgatcgaacgtacgtaatgctacccatgaaaataaaaataaaaataaaaatgcaggatctaggagcaagtcatgagcagaaatttcaacgtaataaaataaactaaaagaaaatctgttttaattgaatgagcaaaaaatttaagcaatcatctaaacctatcatctataataaatttattgacttttaaaataattatttaaaaaataatcaaataatgatttgtaattaaatgatactacaatattaaactcatttaaatgtaaacggccggtgtaaaatgaaaaggttttaaggtttgtattttctaaactgccaaccaattataacatgtaaatttgttaatttttataaaaattatcttaaaatttatatctaacataatttataattaattgatagtttttataacagtcaataaagtatattttattaacatgttagagttcacaagaagtagtctaacaacagaatatagcagtaaatacatcatcaccaacaaattttacaagctatagtaccaccagtacaaaaagaacaattaccataagacataattaacaactacagcacaatatatcccaatccaacagagtaaagattcttacagttagattgcatgaaaactaaactttctttactatttgtgattagtacgttaatactgaaaggtaatgatatgattcacataactaatgtcagcatatgcatatatatatatatatataagaatgtagttgagaagcacaggctgtaactgtactgggaccaatcactgacagctgctctcactctccatgtgtatatagtcttgattaatttctacattaattagatagtttggaactgtgtatatagtcttgatcaatttctacatcatatatacttacttttaatttatttgaataaataataatacttaattatgtattatataaacaactaaagattattaaggagtagggataataataattttggaccaccttaaaagttttcttaaattagcatacctcactctcaaacccactttattgtctccttcctcacactccattcaacttcttcacttcacttcagtgcctagaatatactggtaacctttcctttatgcctttaactatgctccattttcatgtatattcagattgacatgttattctcttgcttcatatgcatgtcaattaaagggattaacattatatgcctattgtgaaaatatttcactatatgcaggttgaactttcaagtgttcaaatgggggcaatttcaacaccccttgtgttggttcttctattttgctgcctggtttctgtttcacaagcagaatacttgaagtacaaagacccaaaacagccactgaatgttagaatcaaggacttgctgaagcgaatgaccctggaggagaagataggccaaatggtgcagattgaacgaagtgttgccacccctcaagtgatgaagaagtacttcattggtaaattgctctcatccaaactctaaccaaatactggtgccttatatgctatgatatagtttactatgcttaatagttagtaatgttttcttttccttatctaagtgtatgatttgtataatataaggggcataacagtgtttgctattatggaggtgacatatattaaagaaatataagtgatgtgatgattgatgggcagggagtgtgctgagtgggggagggagtgttccagaaacaaaggcccctgctgagacttggatccaaatggtgaatgggatccaaaatggatctttgtctacccgccttgggattccaatgatttatggaatagatgcagttcatggccacaataatgtctacaaggcaaccatttttccccacaatgttgggctaggagttaccaggcaagtatacatgtactcaaatagtagtcatgttaacttttgatttatcactagacccttcaattaattatccttcgttaagagataaatcaaatttgactgtcaaattttattattgagactttttagatctttaaaatgaattattattattttttatctgtttgcactatctagctgcttaactgaataaatagccataattatgtaatgctgatagggatccagtgctgataaagaagattggagatgcaactgcccttgaagttagagctactggaattcaatatgtgtttgctccatgcattgcggtaattaagaaagtgttgattcttattttttctagatgacataaaagtttaacatggatctagtgtcctactatgttgatacttgatagccttattcttccacaggtctgcagagatcctagatggggacgttgctatgaaagctatagtgaagaccctaagattgttcaagcaatgactgaaattattcccggtttgcaaggagacatcagtggcaattccagaaagggggttccctttgtcgctggaaagtaagattctgggttgtaacttcacactgcaaaattaaaataaaatagctattgagttcaatgtgaatcattagattaattggtcgtccttgactttatacttccatgcacatatgttggatggtaatagtcattcagtttctgttcacttcttgtttataattgataattattaaaagatttactgcaatttatattttgtgttttttaggcaaaaccattgcattgtatttatacaatcttttacctttttttttattcttcggggatttcagtgtacaaattttgttcttttacttctgtaagttttaaaatattaaaacttgaatattgtttcaaatataaagacactatacccttgcctaaagattcagttaatgaagaaaagaacttctgcattctggaattggtagtttgatgaaagtcaatgttctccggatattttattaatacctacatgccacatgatcaatttctacttggacaatatatatttgatttattggcaaaccttattttgggagtgggataccataaccccgaatttcaaaagtctctaatatatagcgcaaggtatattaatttgtatagatgttattggagtatacatggtctagccagaaacattttatttactatgacacaggaacaaggttgcagcttgtgctaaacactatgtaggagatggtggcacaaccaagggcattaatgagaacaatactgttgtcagttataatggattgcttcgaattcacatgcctgcatatcatgactccattgtcaagggggtttcaacagtaatggtctcctactctagctggaatggccaaaagatgcatgctaatcattttcttgtcactgattacctcaagaacaaactgaagttcagggtaataaataaaacttaatttgattaattctccaataaagcaattgacgagtaattttggttatttcaattatgtgcgattttggttttctaagttttgttttttaggccaatcaagtctatttttaaaatcagaaaatggtcttccatcaaattgaagatgagtaaacatgcagcttttgatgtaccatgggtttattttttggtatctttcagggttttgtcatatcagattggctaggcattgacaggattacttctcctcctcattctaactattcatactctattcaagttggtgttggtgctggaattgatatggtaacaaaagaaagaaatattatgaattgagtgtctaaaatttaatgtaatgacttttcatttattatgagtttatgactttacattattttacagatcatggttccctttaatttcaccgaattcattgatgtcctgacttatcaagtaaagaacaatattattccagtaagtaggattgatgatgctgtgagaagaatcttaagagtaaaatttgtcatgggcctatttgagaatcctcatgctgatataagcctggtgaagcaacttggtagtgaggtatattttctgaaggatgtaatttcgaccatatctttcaaatggaaagaattattttattgatcaattattgtgtcttaaacaggagcatagacagttagcaagggaagctgtaaggaaatcacttgtgttgctaaagaatggtaaatctgctgagaagcctctgcttccccttcccaagaaagctgcaaaaatattggtggcaggaagtcatgctgacaatttgggttatcaatgtggaggatggacaattacctggcaggggcttgggggcaataatctcacagtcggtaagccaacatgcttaattttggtgtgtttaaaattaatctgaaaactacctttgtagaaatctatcaggtggcttaggagtgcgtatataaggtttacttaaactctacactattggagggactatttagtattacatgttaaaaagcatcaactctgaaccataaaggtgtgtttggttttccgttcaaaagcatgaaacaaacattgaatccaatgacaccacgtccatggattcacttgatcatgctttggaacgtgcaccaattgaaaactaatcacacactaaaacctacatgggttaacatgaaaaccactcatacacagcaacttgagatatttgatcataagttttttttgtaggatagttacaaaatatttgacaaaaaaaaaataccattttcctggcaggtacaacaatccttgatgctgtaaaacaaacaattgatcctgctactaaagttgtctacaatgaaaatcctgactccaactttgtcaagtcaaacaacttctcttatgccatagttattgtaggtgaacacccttatgcagaaacatttggtgatagtttgaacctgactataccagagccaggtccaagcaccatcaccaatgtatgtgggtctatacaatgtgtggtagttctcatcaccggccgaccagttgtgattcagccatatctatcaaaaatagacgcacttgtggctgcatggcttccagggactgaaggccaaggtgtaactgatcttctctttggtgactacggattcactggcaagttggcaagaacatggttcaagacagttgaccagctcccaatgaatgttggcgataaatattatgatcctctatttccatttggatttgggttatctacaaaccccaccaagtactaaaaccattaatgagattactcaaaggtctcacggttccttttctacaaagagactcacaattgatttacacgtgtacctttgtaataaaagcgatacagaaactccatttagcactagaaaagaagcacgctatttaaaataaaatttactctggagccttggcaattttatcttataaacttggctttctaattggtttggtaacctcagagacaactgtttaacatatattaaaaaaatctttattttttttatagaggctaatggcagccaatgatccataaaattgatcgtagttgggatcaaggtttattattgtacaatgtttctgacaccaaagcaattgaaagaggtagcggaggggtaagatcatgtagttacaaagtacacgagtttgtgaataacaagcatacaaaattaatagcaatatatagtgtactacacccaattcctcaaaaatagttcacgattttaacataaactaccactaaatgtttgctaaagtgccacatgctctaaaaggccacctttctaggaggaaccaccacattcttgtttccgggaaatgcatttcgtgatatatctaccaaagacttgaagctatagggttcatgcatagatatctctgacagaacctttctgttaagttggatattctccttcatcagcccatgcatgaagttcccatagttgacctggcaaataaaaggaaaagtttattgacaaagaaaatggaagaagaatatgtccatgaaaatataaactcaaaaataaaaggaacaatagaggtgttaaataaatgagaaaaattacagattccagagggaggttcacctaatattcaatccatttgaggctaaaatgtatcactcgcacacaccatgcattcagttcatagtcattttagtacaagaaatatagttagcttgaatccaggtgcatgttcacctaagaatccaatctttcttccaagaaagctattttgcttcaaagactcattttcactttcatggcttcttctcttatcacacatcaaacagacaaaatccatctctaaatataaaaaaattactggtttgctcatccacattctcctatgcttcttaataaagaatacaaattcacttctaccatttaccattagaagctcacatcctacttagcttataactgaaagcaatgacaagagaacaatagaagttgcttggtcttacttttgtaagataggcaacaaaaggaccttccacttttgaggataccagatacatgatatgattagggaaagggggaactcattgaaagctatttcacaaataaattatgcattaataggagaaaactaaacccaactgaagattggggaagtcagtcctgagtttccagacaatgctaaagcaaagaatctcagatttgtaggtaacatcacaacatatgagaaattttcctttggatataggaatggaactacaatgtgactatatattccccatgctccttatttaaaggagcaataatttaaatatataaagcatgggtttgctttgagagctttcaagtggagacattgccaagttagacatgcatacgaaagagttaccacaaggttgacaatcataagtcataacaattgcatcaccaagattttagcgtatgattggtttcctgttagcacaaattcataaactaacgcaaaagaaataactggttattttctaataaacatactttaggctcttactcagcagaaaaccaaataaacttggtcaacaatcaaagtttgatgaaaacaacaatagcaatattgaatttcttggtcaagtattgaattgaaaagattatggattagtgagagaagaaaaggagttagaagacataccccatgaatgcgggtgccagcattgatcctttggatccaaagggatcgcatgtctctctttttgttacggcggtctctgtaggaatattgcaaggccttctcaaccctctcccttgctatccttatgcaattcttggctctacccctgaacccctttgctagcttgaagatcttatccttgttcattttctcctctttgttctttctactctgcaaaacacagtttcaccaaatcacaaaccaagggtgaagtaaaagaaaatcaccaccccctattatcattcatcagacattgctctataaccatgcccaccccaagcaaagacacaaaaattgcacgaagataaagcatatgttctctcccacataaaaggaaaatatcaattatcactgttttactatacattatttcatgatagacaggcgataattaacaaaaagtgctctcagtatctcactttataccaattttcagtttcttccctactgttttgctacagttcaaacttcaaaggactagtcaagactcagaaaacaacacataaataaatcagccctatatgtaagccaccactgccaggctcccaacaataagcacaacacacaaggaagcatgatttattaaaaataattaaaaggaaaacaatgtataaactgattattaaacatctccttatccaataacccagcaaaaaataaataaaaatacgttagaaagcaattcgtactctacaaacaaatcttcacatgatgtgcatagcaatacgcatgataactcaaactattgaattaacataagaaaattgggtgaattggaaacagacttcttagttcctagcaacgcaaacgggtgaaaccaataaggagagggaattgaagtgacccaatgacccctatgcacaaaatccaaacttgaatccaaagggtaacagtggctggttccgggcacgcaaaaacacagaaccagctaacgtaaacacgattcacacaactcaggcattttatcaaacacgtaaaatgaagtcagtgtgatgggctatcatgcatggcagataattattgagacaagattaagtgtctgtgtatagaagcatacctgtgaaatgaagagaacgaaaggttttagatttcaagaattttaacgtgcgatcaccacagatacggtgcttccggctaaacggcgcctaactggtgttgtggtacgctgttgggcttagcctttttggaagattgtttggttagctattattggtactagtactattttttttattttaaaaaaaaaacaggaaataatagatagagagaaatttaatttttaattaattaaattttctaatttattattaaatattttattttatttttgacaaaactattaaatcttttattaaaatttaatcattttaactttttattgtttaaaattaaatttcaataagataagagtgatagaaaatttgtctattatatatgtgatatggtagaaaatttgtccattataatatgtgacactcaaaaaattttaactgacgtgagaaattcttaaaagcatatctatatattttgttgatatggacttgggttcgctatattctctcatgacgaaatatatttctagtttctatgtcgaaatataaaagaaggttaaactaaaacaaaacaatgggttttctaattttcattacattttttattttcttttggattataaagttcttttatctaggattcaaaatggttcattgaatcacgattcacttatataactattgcaacttgcaactattgaataataaatcaacgattatttcttttggaaattaagaatttagaactagttatcgtgattatgataaaattctaatagaaatatttattagccatgtgaggcatgttccagaaatacattaattaaattttgttaattatatattatttaactaataatttacttgaccctgaaaaatttccacgcatatccaccaatatctttacataagcaataattaatagtaaaaagttaactgattaaattaaattatttatttattaatcagctataggttaactaaggatgcaaataaataacatttttaaactatatatatatatatatatatatatataattttctgaaagattttttttttcttttctaaagtcttctatatccaaaaaccatattaaacctaaataaatttcagtcaagttgtatttttacatttaaagagataaagtcctcatgatacttttttggtataaactataaaatggaaaataacaaatctaaaacactacacaaagtgattacatttgtacaatgagggggactagatcatttttcaactttgaaaacatatctgaccaagctttttggttactccaagactgaggttggcatcacaccagtcactacacatcagataaatagtaggttgaagaatttgaatgaactaggttctgcaatctctacgtcacaatcttcgaagagtcccagagttgactaatttcagttcagaccatgtgattcagaagcacctaacaacacataaaaaataccacttcaaaaattataaccaactgaccaagtatatcattagaaaatgtgtatgatcattgggtcatttaaacaattgcccaaaaaagttatacctatgatgctcagaaaaatcttgtaacttctctatgaaaagcatgcaacaattatactttaacttctatctacagagtcgcaaaattttgcactagcccaagttagttaataagagaaggaaaaactccaaatacgagtaggaatcatcacaaccataaagtatcatataaattataacattgaccttattcagcagcattgtgcgtctggtcatgctcaataaattccagagcatcttccttggatacaacattaacacggctgaccctgtttttatgtgttactccatatatcttatcagcaactttcactagctctgggcggaatgttgttgtaataaattgagtgtttgctatgtcagccaagcgacgaatcatatctatggaagatcaagaattccaaaagggacaatggtataataggaaatctagatatcattcagaaagaatatcacaagcatgaattaatttttaaatttaaatctcaccaaaaactcgtacaaccataacataacaacaacaaaagccttgtctcattgagaccaccaaaacggagagaacagagactaaatattatattgacttgatatgaaatataactgatgatattgttcataaaacctaaagcacaaacccttatctatactaatcaaattaataatcctaaataaataggaaaaatatcatgggataaggaagtggaaaccaatgtttacagagaataagaagatgggaaaactaaccttaatggataatctaagtaatggataatcaagatataataacattagatgttttcaaaataatctacgagatgtaaaagagattgtacggagtataatggaatggaataatattaggttttattgtttggataggataggatacaatgaaatggaatctaatggactgcattccatctgtccctaataccgccttcttttcctcccctccaatttgaggggtatgggacggaaccacatttttttcccaattcatcataaaaatatccaaacaatccatttcattgcagcccatcccattctattccacacagttttgagttgagtcattaagtgataggtacataatagcaggtatgttttcaatgattgaagactcaccatatataacatcaacctaaacctctactacctccaatatgcacaataaaatttcatttaatggaagatgaggtgtgcagtaaatagagatggaagaattgcacaggaccagacatttgacataatatgtagcaagcataaaaaggatacttccaacagcagttctgtactgtggatccagcgctgcatcgatctcatcaaatagataaaagggagccggatcacatcgctgtatggcaaagataagtgtaagggcgacaacagttttttgacccccagacaactgcttcatggactgtgtctccccttgtccagtaaatgagacctgcaagccataaacatgtccagaaatgtcagaacttagatgctatgttatgtacttgtaatatagtagaaataacaataaccaattttttgaagcaatgctggggaaactgcagtaaaggaccagtgaatgacacagctattttaatgcagtttgtgttgttacatgatataaagttttgcttttgattggttgcattacgtaagtctaaataaaaaccagaaagaaaagaaaggaaaatatctccagatatgaaggaaaatatctcctaccccacactattatctgactcttttaacgtacaaaacaaaccctcaagcattccgaaacaaacaacaatagcctcatcccaacaggtgtagttaacaaaccctcgagcattctggcagaaactttacattaaaattaaaaataaaaataaaggcataaaaagaatacacttgccttcactttcactccaatgtacttttctactctcccctctggatttgcttcacgaggaccatcctcatcttcgtcgtcatcatgatcaccatcctgagggaaaggaaatacaatacagaaataccactttcatatcaattacaatgactaaaaaaactttttgctggagattcctcgcacctttttagcaaaatacaaagaaataaagcagtaattaagcaccacattcaaacaagagaatggaatcaataggacatgaaaacattaagaaaataatgtccacttaaaactattttaaaatgtgaaaccaagataacaagttataaacattttttctcattcaaaaaaagaactgaatagaaacgtgataagaaccttgggagaaccacaccacaaaagctagctattgtagttggagagcccaaggccttataaaccccacaccagaatcacatgtttccaatgtgggactccaagtctcatacgtagcaattgaatcctaacaataagtcaagaatgatcacaaaccttctttttcatcataaccagatgaccatgccccccctgcacaagttcggaaaatacttcccgaaaatgcctagcaacacctttgaaagtgcgttctattgactcgtccttccgttgatctagcactgatatcagctccttaattttctgtaattattcaatacaataagtcaaatagatggcaatgtaggatacattagttgcattggaatcagtccaacttgcaaaatcaagcttgaacccaaatcagacataagcattcctaggttattccacatataggggattggttaacaagacctactaaagaggcacataaaaagcaactttcagagccatgacagatcagttgcactaaaacatttagatagtaaagtgcagaactaacaatataagctaagcagtgtagtccttaaagacttttgattctttggggaataaagggcattccaaatgaaaatccctgcaaagtacctcatctcctgcatcaagttcagcctgtcttttctgaagttcttctcgttgttctgtaaaatttatatactggtcaagtgctttcttgtttacatgactgaattgctgcaattgctcgttgcacctgtgcagcattttgtgcaaatctttaatattccttcgtctatacctggcatttgcaatgagtaaaggaaaggaattaaataaagttagctaaaaacaaagtacagagaaaatgataaattgcaatgctgcgagctatacactgtaatagcaccatatctggcggatcatcaaacatatcatggcacagtaatcaagtttacccccaaaaaagactaaatacctaatattaatttaaaaaaaatagccgaaataataaaacattccaaaattgttggagataggattattttcctgttcatatgcttggacacatgctttgtctgaatggatgcaggagttagccatgccatatttaatgacaaaggagtgagaacaaatgtgttcaatgaaaatgtatcattgcagaagtttggaatatctgacgagtacaaggcttagttaagaaggtgacaatatcaaatagattgtggaagaaaattgtcacttttcctttgctaatagaaatggagtcctttaatgcttttcatagcatatttcagttttcttttcatatccctctaaaataattcatctaatgcacacacaaaaaaaatggtgaaagaaagacttacgcctcaaaagcatctgatgtcaatggccccagttcccttattttcttggcatattcctcttctttagcagcatatgtattttttttactctgcaattgctctaattcttttgcatcttcctgaagtttcctttcatactcgtcctccaaatactacagccaaaagctttcatcattgttgggagcaataatacatatacccgtgagcaatttataaggtcattattaccttcaatttattcaattcatctttgatctttttaatttgccgtgttcggtcatttatactttcagtcacacctggggaagaatatttggttaaacaaggaaatatattcaagatatagataaaagactagattgattgaaaatttgaaggtctcacttctaagctgccctgttgcatcatcgaccaatattttagcatcactaagttcctgccgttttgattcagcatcagcaaccaaagagtcagcatccgcagatgatattacagcctccaactcttgtttccttctcctaaggttagtggttagattggtatcaagctctgctctccgtgcttcagtctgcaaaattttaagccagaataagaacaccaactttatgaagattatgagcaccaatacaattgattgaataacctcaatacgatcagtcttgcaagcaacaagcttctctttaaggtctttgatttcagggttcagatctgacaaaagctttttttcctctggtgttaaatgatcaatgagctcagtgcccatctcagctttcttcatagcgatactagcattaagctgttcaatttgattctggacatccccaacagacttctcctacaagtaattacggaaaatggtattaaaaaagtagtgaaaaactccacaagcaactaccaaccaaaagtagctccctggggataattaagtataagtgagaaattcaataacaccttttttgtaagtgctttagaaatcaacagcttctgcttattagcattcgcaatatcctgcttaagctgttcaatcacagatttgtcatgagcacatttggcatcaatcttctgctgttcagcaacaatttcattaatcttttggtctgtctgtaagactaattcagtgaaaacaaccattggaggaatagcttaggcatcaaagaagtcattcacaaaaacagagaaatatatgacatttcatgttgtcaggtcaataacaaattgaggctctcttacaagacttttagcataagataaagcaaataaatcatccaaagaaaaaccaatcatcatcaataaataaacaaatgcaagaaaaaataataaagaagtccctcgataatagagtccaaaagaaccactggacttcagtattatggaacaattacatgctataacacaaaagttttatcctcaataaaacctaggtagaacatcttattatctttaacttcaacttgacacatttctaataaaacaattttatgaagcagtgcacctttactcattataagtttaaaacattcttttaaggcatcaacaagaatatgccccgagaaacaagaaaaagtagccagcacactagtaaaattagagaggtaaagttgcaattaatcgaagaaatatcaaatatgcattataacaaaaagtgaacacatctaaagtttcctttatcctcactcttggagctattttcttccaacaagcagatcatctggattttctttcctttatttcctcattttttatatgcattttataatgagtttttgcctaagagaaatgaaaactacaaaaagaatattcatttattaacataaaggatatcttgtagattaaatctaactttctccaattcctcctctctaatgtgaatagtgtctgcattctgcttaatgatattcataaacctcaatcttgatcgtctgtgatcataaaatcctccagtcatactgcctttcttgcttacttgatcacctgtaataagtcaaacaatttgtcaggcaaaaacacaagaccagcccagatcaagtagacagacaatgaaaagaactaggccaaccatccagcgttatgcagtccagaccatcagaacgagcaacccttgaagccacatccaaattcttgcagataactgttctagcaaagacctatgaaatatcacaagttaagggacatcaaatgcaactaaataattaatatttaataatatactatcacctaattatttttactacattagcatatgcaaatgtaaatctaagattccaacttgaaacaaagaagcagaacaacattaccttctaagaaaatcccattcaatgagtctcacaaaataattttctataaaggttttcaactgaaatgtcttgtctatctcataagcacaagtctaatttactcagccaaccttttgcacaaactaaagcatcaacgaaagacataatagattcgccatcaaatcaacggcaaacatcttatttactaaaacattaaaaataaattaaaaatttccattttctacatatagttgattcctcattattaatttccatcttatttaatatatatttcttattattatattattcagaatttattattattagtatttagctaattgtattatatattatgttttatttagttttataacaattattagttagttgattatgttttttattactgcaatttttaatttattatcatatgttacgctttattaagtttattatattatgtgctatgctctaaatagtttttatttttttaatagtattataatttttattattattatttagtttattatattatagcaaagattatcaccagataacaagttaaaaacccacccttgtgaaattacatggcagagaaatgttggacttgaggcccgaggcccaacagattagaaaaaaagaagaagaaaaaacatcctaaaaccctaaggacctgacccatcactaaccatgttctttgttagctcatgcagccactgtgaaaatgaatagtccctgttagagaacgcaaatggaagagtgggtggtcggcgacggcacaagggaggtcacagagtatccagcatggcggatttcacttgggcttcatagtcagaagcacgaccgcagccactccaaccgcaactctaaaacgcaacatgaaggaagtctacatcacacgtcactgtcgctctgctgcgatagtggccactccggccactattgacagctatgttaattactgtgtttacattgaaaattttctagtgaactcctgtgcgaaatttgaatttgaacataacacagatctccccccttgttttgaaatatacacattacacagtaataccttcaatttcaaatcttcatccctatatagatggagtgtatgaatctagtaaatatcccaacaggatgtttatctagtgagaatctataacacgggaagagacgagtctaattgaagcaaaatcaggatcagtacaaacaacctgaagcaggttcataggtaataaggcctgcccactagatccttgtgctgtgttacagtagtttagaaactgttaaggaagagagaaaacaagaaacatgaattctgtgtctaatttacacagcggaggctcttattcgtaatgtctacatgagtcataaatgcaatgaataatggttttcttgtttctcaagaataggggagatctctaaaataagagaaaatgttaaacttttgataaaaacatgataataagccctacacaataaataataatcctttaataccatgattattataaattaacatgcttctccattatgcatcaatttttcatgttaagttgatatctgatagaccaaaacctcggaattattttattaccaatagcacataaagatgttgttgtacccatgtgaaataaaagataacatttgtttagaagctaacctgactgaatgcgggagtatagtcatgtttaaaattcaatttctttaaaagaggtatgacatccgaactctgtggataagtgatacgtggagcctttactctgttaagtggaataaatgtaactcgaccacctttctgtgaattaagatgtctaattatctgggttgacttgtcatcattttcaacaaccacatgaaataagctgttcaaacaaaagatgttaaataaaaacattaagccaaatgtaaaaatataaaaccagtaaagaaatcaggccaagaacaaagactaaaaataacaagatggaacaaccgatgtgccaaattctcctgcccctcccccaaaacaatataggaaactgatcaatgcaacatgtgatgaaatcaatatgttaaaagaaatatcagagatgacctgtttgctgcagtaacttcaacagcagtgaaaaacttttcatcacaattcagcaactcaataattggaccatgaactccagaaatgttatactccctgcagatcttcctaactgaattcaaccctcttctcacatcctgaacatcataatagtgtcaaacatggtgatagataaaaacaaaacctgtcccaagaatgataataatattatagaaacatcatggcagttaaccctcaaactcaacagataaacagcagcataagatctaagtatccatgactcatactattttggataataattttaatccccacccttacccattggggtatctaggtacccatacttaccaaaattataattaactacaactaaaaagtcaaaaaaatattgattaaaaatacaactgtaattcaattaaaatactattcaaagattttttataaaagattacaaacataattataaaatattaccgtaaacttccacaataacaaatttataaacattcaagtccaatgtggagcaggcgatcatacacctccaatgcagcaatccatgaaacttgttgggtagtatcagttacaacttgcaatacacatcatgcgatcataaagggagttggggcttgagtgcaacgtaaaagaaattaaaaggtctactaaaaaaaaaaaaaaactacgtatcaaattgtccagaggttccttgctatgtgaaggtaagggggagggatattatacgcagtcttaccctagcatatgcaaagaggctgtttccggattcaaactcatgaccaacaagtcaccaagacacaactttaccgttgtaccaaggtattagtttcaataaatttcattttttgttaatttattattatatcataactctctctccgtacctgtgcccaatgttatcaaacttgggctggtcatcgactcggtctagatactaggtcattgagtcacgaatcgacacagtcaatcactaattgacttgtatgacccagtgaagttaacaaatataaacataaatgtatgagtagcaaatataaaatcaaattcaatgaagttaacaaatgatcacttttagtaatgtaatgtaataacttataaagattatcaacatcaacaacacctctaacccaagctaattgggattggtagtagatgaatcgaatgatagatacaaggaggttaaaaaaaaaaagtaaaagcaaagaaggggaaaagaaggaggggggaaatgaagagggaaagaactaaaaaaggaccatatgcaacatagagataacaacgggtctaaccctccaccaaacttataacttttctccattccgtccgaagcacaccgtctgtcaatctatatcttattccattaagtattgcttaagtacctttctccaggtaagtttcggtctatttatacctctctttgagtcgagcttttggtaacaaacttttctttatatatttatcatatcttctatcatatcaatattattatcataaatttattcatgataatgtatttaccaattcaggatgtgttaagaactatctcattttaatttatgatataataactcatttaccaattcaaaaattaaaagtacttccaccaccaaacaaaatcattttatatcttctatcattttaagtgtaatacaatttctggaattaaagtgtttctgcaatctccttcatctatatactgcatagaaaaatgtaaaaaccctcaggccatagtcaaaatcatccacattcttttagagtgacaccaatttacaaatatgatggcactttgtgttaattcacatcaggtagaatataagttgcaataaaattctaaactaaacatgcccagactaccccgtacatagtgaaagattcaatgcctagaaacaccgtgttgaggattcttgacaatttaatggcatttacaaaaggagatgttagaagttagaaagaggaattacttacaccaggaattgcatgatcaagactcttttcagccttctcaacttcagctctcagcttatcaatttcagcagtaagttcattctctttgccccatagggacctataatgtagcaatttaaactcataagaaatattttcttgaccagggaaagtaataaataatatacttttgcagtttactatgtttctcctttctacttttgctaaggagggcaccccatcctacactttcggtgtacacattcttcactgtaacaatatttcttcttcatctagtaaacgtctacatagaacttttaaaaaaaaagagacaaaagaggagttacatactttctctccccatgtaacttgtctctctcttctttgtaatgattaagcccttcacgtgactgagcaatgagagattccaaagtagtaatttctgatttacgtctgtttatattctcatcacaatcctgcagttcttctttaagccgatcaatttcatccaaaagcttttgctcctgcagaccaaaacaacaatcaaaaacaaggaagagagcatagtacaagagaccattgttcctataacaggagaatacaaagacagattaacagtttgcaaatattggaacccatggcaagggtcactgatcacatgaaagttctatactcaaagaatactcatatatcaatgttaataagttgagtaccatatggcttaataatagttaaggtctacgtctttacgaacatatgggattcaagtaaaatgtaaatatgtaaatataacccagttcattttaaaataagcagcatagaaagttccattcagctgagtccgagattgtttagtaacaggtttctccttattcaaagagcgagcaaaaaaactcaagtgtcaggtaaaattctcacggactcttaaaaattggtagtacttttagagagcagttttttgttttcataggagaagtagacttcaaaatcacaagttagctggcttccaccttttgcttttaaaaattaaaacaccaccaaaacattctcacgattttttgagatatcattataccatttattcattagagcataaaccttagcttctacaagcagcttccacaaatcaacagcaagaccaaattgagctagagtatttggaaagaagccaattagaaatgaagcatagataatgaagaaatgtataaaaaggaaataatccaacttgaataaaagtagagtatgtgccaattctgagagaaaaactgtcttctcatcatgttgctcgacatcacacaacaagaatattttatgagttctctaataggaaatgcagtgagaatgacaagcttagatgatattgtttgtagtggcaatcacacattttgtttcttcgatggggaaaccatatcctctgatattgtacttctttcattctattttctaataacacactgaatgtttaggaatgactattttcccagaaataatcacttttattttccaaaatctaccttaggaagttgacaaaagtaagtgatcatttctcccagttagacacgcacttgatctggtaggcataaaaacgtgggaaaaaaatgcatatacaagttacaacagagtagaaagatgattttgttatcacatttaaaattaatggaacacaggattaaagaaaagcagacatcttcatgccatgaatctgttcaaagagatatttaggacataattcattatagctctacagataaatgaacacttgcctgccccttgtttgaagaatgcactcgttcaagatcatcaatctccttttgaagccacttatcacgagaagctttacttgaaaactgggttgcacgtccttgtttttgataaagtatactgagtttcttctcacgttccattattctaacaattaatttattgtgggagaaatactaataagaatctgttgaatatcctcaacaaatgatagaataaatttcaaaaacagtacaaacaagtgaaaggttaacatatacatatatatatatatatataactatcctacatcctgactaatccaaatttatagctagatgagaaacactaaaaaattaagattaaccagttataagagtgcagtaaaaaacataaccaccatgtcagaaagtttgaatacataaactgggagagttagatacagtacactaattgaagcatattgaaagacaagtatatccataacctactgcttggcaatgtctttttctttctgaacttgatcttcatgtaaaggaataattttgcccagttcagcagttgaatcttgaatttctctctcaagtatctccagttgtcttgcagcatcttcctgaaagcatgtaggtaaaagatgagccatgtacaaaaccattccaacaaaataactcataagatgaattcttcaaattagtactttggctcgggtatttccagagatcttctcttgcaagtctttgacatcaagctcaagctctgtgtgcttctttaatgccactgttcgtcgcttttcaataacctctttctctttgttaaagttttgaagttctttcgatacatcttttaatgtattctctaaatctttggatttctcatgtgcatcaagaacatcattatacttcctcgctgatgtgtcagaaaccttggtccgagcatcttcaatctaaaacaaggtgataagcattcaacttcatgcatcacaaacccaatatataacgacaatgggattaaaaatgtctgaacaaatatatatttgacattcaatattatgattgatcaacaaagaaattaaagtgtacaattataaactccaaataattgcatcgagtatatgacaggccttttatccacatttatagcaagaaaagaggagttaagggtatcgagttgattacaaatggaccacggggtccaatggagactcggtcagaagagagaaagaggggagtagcacacgggagagcagttgggtaacgcagtgcaacagtgacactattgagcgtgatttagtaatatggttcagcacatgaggaatttcaatttctaaacagaaaaaggtttaaaacttctactgatttatgcagtgttggatatcaactaaaacggaatgaaaataaagagaaacgaccgtttcaccttaaatgtgttctagaattagctattaaattgtaaaagggggggcatattttgttttttattgtccttcaacaaattatattatacagcttttgaagtttttcatgaaaactgagtacactcacatcacagacaattgaatcaaaccaaaccagaatattaattgaaaacatctgtgaggtactcataagaatttatttaaactttcattgtcttaactccagtgatatagctgtgattttgaaccacacagcaaggttaagaaccaaaagaatatatcatcaccaaaacgattgtgactaactacccaatcatcaagaagtaaatccaactaataaaacacagtaggaaatcatgcaaataattatagaagagagaaacatttatcacatataacctctgtaagtttttgctgagcttcttgaacttctttgctataaatagcatattccaaggattttctttgcttgtcaagctgctgatattttctaagttcctccttctcctcatctagttccttcaacctttcatctaaatactgtacaacttggattatttgctttcttttattacctgtctaacagaaaaatgcatgacaataacaacatcaataacaagaataataaacactagaatctgtactgatgtgatgcatgaatttatgaaatataaaatattttatttcatattattaatcattcactaataaagataatattaagttattttttaaaatatatattttagtaaatagagtattataaaatacaaaatactaaactactatttagtacctttaaaatttacttgatattaaattagttattaaaaattttacaatatcaaattagtctcccaaataaccaaaaaaataattattttatctaattattaaaaatcaaaatatttttaatgccttttaatgcttgatggatggagttgatagcacaaatatttagaggattaaattaatattaagcaaatattagaaggagaaattaatatttaaatctttgaaataaagttaaagtattaaaatcaagtttataaagtttgtttatacttattgatagagagagaggcttattagaagtacacactaattttcagtataaaaaaacttattataatttcaatttcatacaaagaaaatttaaaagtaagaatttgaaggaaaataagtttccttttgatctcatccagtcataaacttaaaactatttttaacaacttttaaatttaaaattaaggaaaatatttattttaatgtaaatcaacatgtttgataactagaagcaacacgaggtgaagacttatccattaatggacaccttgtctactgtaagcaagaagtactcgtccagtccatccaaaaaccaattgagataagaatgctacttggatgttcttagatttaggggaagtctaagggttgtaccaatagtgaccttgagaatacttgtaagctagaagtgacataaaagaatacttgttgtaatcaagttttattagtggaaccctttactggttggtagaggaaaatttggacgtaccccagattgaatgaacaaatataaaacgaagtatttttactactcttctttaactaatcaaagcatttcaaagtctattattgacacattttgcacacaaaattttcacggaaaaataagttttatacatcatttgacgataacccactctcaatcactggacgagggttcttaaaaacttgtttatcacaacatcttccttttcaaaaatgtcttatattttgactaacactattcaatttccattatagtgtaatttattgtatttcaacactatccatatcaagatgaagtatttaatagcactttttaactcaatgtatacaaatataaacaaattttaagtattattaataaaaattataaaaactaaattaaataaatatttttcaaatattatttttgttttaagacttgcaagtataaattatagctaagtaaaaaaagtaccaatacacattatgtttatgtatgtatttatgtatgtatgtatatatatacacgtgtgtgtaatatttactaaaaataataatatgcttcttattgttctttgtttgaaattttaaaacaataaaaaaacaatgtaaaaggttgaaaacataaaaagtcaagaaacaaataaagttaataaaaaataagtgacgtaataaattaaaagaacttaaagagaaaatatcatgcggtaactttagtagaagaactttagtattatatgtagattacaaataatgaatttaaatgaataacaaataaataggaaatactagataaatcatgaacttaaaaataaataaatcataaacttgccagtttcatgcattattttcaaactttcacgacgtctctcctcataaactctagtaccacctatttccttcagcaagtcaagtcgttcagagtctttcatcaaggttagtgatgctatctgtgcaatagtaaaaatgaaacaggtttagaaattagattcaaagtttataaatataacaatagtaaatccaaaaccaagttaaagcactgtcaccatcagccaatacctttccttgttgtacaacataataaggatttgaccgggagaacccagcactctccagcaaattcatcacttcagtttttctgcaggttgtacatgatctttaggaacaaggtaaatactcatacaaccaaacagcatacaataaaataagacatttttttctgaagtgaaaaataaatgcaaagtatatgctctaacatgtaattctatttcactcacgttatgtgctttccatctagaaaatactcatcctttttgaaacctatagtccggcgcaagcgcacttcctccttgtcaacctattcaccaagacagatagtgcatagttaagaatttcatgcataagtgattttcaaacatatagcaattttgttgtcataaagaaagtacaaagaaatcaattatgaagacatgcaattattaattacatcaacaagcatcaataacaagatttttctttcggcataaaatagttttataaaaattgaaattgtatggtagaagttcagtgaaatcaaaacaatgcaaagcacttcatcattaatcaaattatttaccagctagcagaaacttcgcaccatcagaatctcaatgccaaagactttcaaaaatggaatgaaaagatgtttatccaacatagagaacaaacaagttaaaaatggcattgagtgaaaagaggaaaaaacattatacaaatctagatattaagtcttcattcagttaaatacaaaatttatctgttattatattcttttctttgcctacaaactcatttctgtaagcagcatgatcacaatatgcattcattgcacaagaatggataaatatccaaccattgaccagtcaaaaaggtaccatagattaaaaatggcaaaaaaggtgactgttttgtagaatccaattcatgtgcatatgccctataacagcttttagacaatctatcctttcactgagaactgagaaagataagtgccaaaaaagtcccatttttgtcaccatttaggatacactttatgaacaaaaaaagataaatagcatttcgttttaataacagtgaatagcgaatagaagaaaaattattatcctcaacatattaccgggatacgattgtctgaattatcaaacacaatctccacaaacgcagataaaacctgatgtccagctccttcctgtgcaaagaataatttatttaagcatattcaaattctataactgattagttataggtaagaaccagaaataaatggatgaacagtgccatacatggagtagtgcctgcctatcttcaccgcgtaggttttgaaagagatcacttaacacaaaacggatggctgcaaaagaaaagggtgtaccaattgaaggtcagagatatgatttcagttacttccgaagactaatggcagtcagtaaataaagttgatacgaagaagatatggtgatttcttaccatggaaaaagtttgtctttccagatccattagcaccaactgaaaaaataaataattgaatagatattattaaagttacaaacaaatacaattcagatgcattcatcatttgatctaaataaaaagatcgaaattcatctttagaaacaacttaacattaaatgaaatgtaattaagagaaaggaagaatgcattagagtgaaaacaaggaaaaaaggaagcaatcaaactgaagacaatgtagtgagtaaagaatgcagatctgccaaaaaaaaaaagtatgcagcctttagcttgatgtgagaacaaaacctatcagcatagcaatcaagcaggatgagatcataccatggttttcagtttcacagtaaaattcttctgtgtctccttaactgttctttttatggacattaatggaactgaaaaggtgactttcaagttccaaggcaaagtctttcatttggattttgaataacaataatcaatagaattaataaatatggtttactccgaacaacaatcttaatgaagcactttcttagttatccattaatctttactagactagcaagcatatcctacatagttcagatgatggacctatatatagctatttaaaggttttgaaaagataagtagggtactactctatggaaatgtgtagaatgtagatattgcagttaattggtgttatggtaggagatcaatggcaggattttcaagaatatatgtatgtagtctatgcaaatatatctgaattcaaataaaaattgactaaacaacttattctacattgcctcaacttcatgctttgtttagctgccatcataacatgtcatgaatgaaatacccacatcacgcatgcatttcaaaggattttccagtatcaatataagaaagcatctaaaagcttttcagtaaaattattaccaacacaattaactttagaactgaaaggttcagtggcaatttgctctcgataactcttaaaaccttcaatcacaacctaaaagcacacaaaacaagtacattaaaaaaaatggcaaagaaccaactccaaaatccaaaaccgaaataacagcatattatatggtgtttgaaagagagaaagtgtttatgaatcataatacataaacacaatctagccagatctaataatttaggacacggcagaaattaacaagattaaattaattaaataaataaataaataactccaaagtgtaattacctgcttgatgtacatgttgaaagtatcataaccgtacctataagagccaaaaaaaaaaaaaaaaaatccatacgaatgaacgcattagaaacacaacacagagtattgtacatgctatctcaagtttcagcaatagtgtatttgtaaaacataagacaaggtactatcacaacagaattcaaaaattcaaaaataaatacagttgagcatatccagaggaagttactttagctattgcaaagtcagagatgaaaaaaccggattccctaagcagtttcagtttcaaaaacagtctaataaacaaggcaatttggatttcaaaccataaaacacactatagctatgaaatttctaggtcacattcgggatatgaagagtgtcttaacgttttctgctgagaatcaagtatgagaacaggaaatccaggtaaaaccaatctcgtagatagtgttagggtttcaaacgaatttcaaaaacactgagagggaaaagagaaattgcagagcgaagatgaaagagaagcagaaacatgtgaagaatatacagaagttgatgggagtagctagagagtacctcagagaaagttcagtgacaatggagtagcaaagttgaagttggagcgttctgtttttcgtttaatgggtttcggggtgcgaaggataagccgtgcgctacggggggtggattttagtaccacttggttcgagcggacgtggagggaatgaaaaaaaaaaaaaaaaaaacattacaataaacgcggcaaagttttgagaaaaagatttttctttttttttttttttttacgcatcagtgttggattttgcgctagacattagggaaaaaattccacgaatttcaaaaaataaaaaaattcgtagcactgtgctccccttggcaggatgcactaattattaaaaagtttgatgaggagatggatagaaataaagttatgaaggaggaggaactatgaatgatatttgatggttatctatcagttgaaacatggtctccttttttctttttcatcaaaagtaaaaattatggaaaatattgttcgagtaaggtttccaagtttaaatcttttcttttgtaacgactaacgaatgtattttacttgctctagtagttggagtgagaaagccaattaaagtttatgttaattctattgatgttatacgtgggaggtttgcttatgtctgtgtagagattgacttaattgtttcagtggtagacaaggtgtgactgcaaatccacttatacaagattgaatatgaaggattgcacagaatatgctataattattgatgctatggacatttctccaaagattgcaaagtttcatcataggaaattcctcctccaccttcttctgctgatgctaattcctcttccatggtgggagtacattacattcctaggcaactagcgtcgaaaaccttagtcgaggaagcaattacaccagtcggtaccacacaggggaacaatagagttaattccatggttaatgttgtaatggattctttgatggtgactggatatttgtgcaacgtaaaaaaaatggatccaacatacagtaagagaagggatcctaaaacaccaagaaaaaacattaattaacatcatataaaagtgagaaaaaccaaaatcagtaaagacccactcccaaaaggtttactacatataaaggccaatcattttaagtgttggattcaaggcacacacaaagtcaaataattttttttaattcggtaatggtgcaacgtctacaaagaatatgaagccagattcaaatgtgcactatacaatgacacatgatgatcttattactgataatgaccttcataataaaatgttacttgtgtgtgtgagtgagagaaaaaatctgaaacgtcgaaaggtgcattttatcttctgggtgtgattatacgcaattttatgtttttttcctaaaagggggcaatttttttatttactaattggggaaaagttttaaaaaaatcggattggggataaatcacgccaagtgtcacgaatttttttttaaaaaataaaaataaaaattggtcgttaaagtttagttgctaattaacgtggctacttccgtctctaacattttttgcgacaaaattattgtagttgaaaacataaaaaacaaaaaaatcacaatattctgtcacaaaaaatattagcaatcaattttattttttttaaaaaaaagtcgtgacacgtggcacgacttctaagtcagaagtcgtactacgttacacaacttacccccaatctggaattttttaaaaacttgctcctaattggtaaataaaaaaaaatgccccctaaaggagaaaaggcccaattttcttgtttatgtctgcacctgcccaatggtattcgtattaatatgaattttcctttattctaactgagatatgtgtacattcgtctgaaaaatctattttgaggtcgattagtgcctttcaccaccaagttataatttcttgctcacttttttctctcgaattttgaagaaaaaaatcatcttccattgttgctagagtttgcaaaacgaatcgactcaactatcttgcaaataacactggactctaaataagatggtttaaataaaaaagcctttttaactccactcacttaatgagtcaattaggctttataaactttagatttactcgatgactaacataaatataaaattaaattaaagatatagtataagaaaacaacataaaaaatattattttggtaaaaaataatatattattatttaatattaagttaattaaaataacattaaaagttcatttgattcattaaaaattatgggtgttccatatttgatttgaaaaaggattagaaaataacacaaatcaaatagatgaggatgacattaaatatctaattattttaagagaaaaaatatctatattttgttactcataaaattatacagatataaaatattaaaaaaagattatagctctatttttatctatttaataataaaaacaataattaactaacgaaattaattagaaaaacataaaatcttatttatttcaatccctctatctttattttaataattatataaattacattaagattattaatattaaatattttaatatattttattttatttatttatatatttcgtcaaataatatataagagagaaaaaaaattatactgtaatttatgtatttatccgtgtgcattgttctttttgatctgtgtaatatcataattttaaggaatcaaatcaacctaacataaagtgtgggataagttttaacttacgcaccctcgtacaggcggcacagcttcgtcccccgttccttttctcactggcaaccctaacctaaagtctccggtgcgcacagctgctctgccgtgactctgtggtcgacggtataaagtatatgccaaactattgttaatttctcttcctctttactccatcattgatcaatctatcatatgtgaaattttattttaccaaatatggtggttgtggttctgaatgaaatcagattatatgattggcatttatgaaaaagttgaatggtctaatgccgatcaaatttccgagctaattcctgtttctgcattttcatcagattgtgttgttatgcattgttgcagatgaaggtgaaaaagcagaagaggcacaggaagattttgacgttttacactgcttgcttcggttttcggaagccttacaaggttctatgtgatggcacatttgtgcatcaccttcttgtgaatcgaataacccctgctgacacggccattggcaatgtcctcagtgctacggtcaagctgtacacaacaaggtcctttttttccccctctctatgtttaaagtagatttattaacatttttttcttagttcaacatcgttggtatgaactatgaattgtgatttgttttgttttggataccttttgttttttatttctctttgttaatttggggtttgggtggagatgatgcagatgtgttctagctgagttgaaacgacttggtagctcgtattctgaggctcttgaggcagctcataaacttatagttgcaaggtaattcactttactgctgggtacatatgctgttaaatggattctttcctcaactttactagtttcaatactatacatgaatgatgccaaatcaaataaccagaaccagagtacatagcttgttattgttgatagttcgatactctttgatcagtgtgtatttttgtatatttaaaattcagacggaactggtcatacatgactattttaatgttatttttttatgattttgagcgaaatgttatgttaaaaggctcactaatttgaagcaatgttgtatttttagtcctaataattagcatctgatagtctttaaggggactactagtcaggatcattgttgtttgtttattagggttttgagatatttgagcgctggtattgctgtggaaatgatcattaccttgattttactccaatttgcagatgtgagcatgaaaaatgtaagagcgcagatgcttgcatcatggaggttgttggagaaaaaaattctgaacatttctttgttgctagtcaggacactgacctgcggaaaaagttgcaagaggtttgttacatatgtataatatatatatatatatatttattttaaatgttgattctaatggttagatatgtctttctctttaatattttctttgtaatcgtggtaaaatttgtttaattaacgaactatatttttttaatgatatccagcctgaaagaatcacttctacctatttggactcagaatacatttgtcttgatattaggttcttggtagcaaacttattatgattattttaaaaaaagatttatattattgatactctgaaagatagttgttacaggtatcttttcattctgttgtaacacttaaagcttgttgaaactcattaactgagcaaagccatttatcttcaaaccttggttagcgagacgtggtggatttgaatggagcatcaatttgatgttgctatctgtggaagatgggttactgattgatgtatactagtacaattgatgatcttgttatttaattggctgttacataacaatcttggagaatttgtgtcttgtccagtctagcattttgaatatggaacttctggttagaccagaattagagcaattttttaaaatagttgctatggttgaattgtggggaaacaaggagacagtatcttgtttagtgcatctgcattatctttgcatcttcatactctcatttcatatctttcattctatttaatacagattcattgatatagattttgtcagtaaacaccttctatattctaatccagttgtatcatcttcccatttctaatcctattcatcccattgtggttgcatcaccttgcctaaatgtgtgaattatcttccaacttggtgttactgattgaggcatctgctagatttcaatggataatccatccagcttcttgtctcatggttgattatggctagatggaagtgtagagcatttctagtagttatttcttgttagagtggttgaatacaaaattctttaacatcttcatgtcttgatgtctatcccatgttccttccatttctggtttattacattatgaattttaaatggttgtgtttcatttttcagtacagccagggttcctatttgtgccattagtgaattaccttactatgtgtcctttatgcactccttttgacattttctgattgagtatggtgcttttcccattaaaaggggaaaaaaaaaatgaaaacttctggttctttatgtctaaaatttgaagtgctttcataatgatgcaagatgtgtagaattgtacacttagacacacatttattcttcttaatctgcttattgcaggtacctggtgtgcctctcatatttggtcttagaaatgctcttttccttgaatctccatctgcatttcagcggcaatatgtcaaaacttctgaagaaggacgattgcacatgacacagaaggagtaccagatatttaaggatagggtaatgaatagattgactggtgaggaagccagcaattccattactgaaataaaggaaattgaggattcaaaagatcagaccataaatgtgcaggcagtagagaagggtattactacaagaaatcgtatggaaatcaaggataaacctcagttcaagagaaaaagagctaaggttataatttacccttgtgctgtatctgtttcctagcttgagtttggttaccatattcagtggttaattgtttatatagacttgaaacgtttatgcaaacaattaatttctttgtaatgtgtgtgtgtgtgtgtgtgtgtgtgcagttttggatgcattttgtgtagaaagatgtcctagttaatttacaagtgaacttaaatttgacattagtcttgagtaaagctttattactttttgcagcttatgatttccatttagaattctcatatttttatgatactgcttttaaactttgcagggtccgaacccactttcatgcaagaagaagaaaagtgaaaaacaaaatattggtcctttgaaggtaggggttagtaaaatttatgttttttcagcgacggtgttatatgttttatttaattttacaatcctctgaaaataaactttgtttcctaaatatttgttagatgtttattaattgcggttcttatgcaggaaacgaatgaagacaacacagtgaagagaagtaggaagaggaagaggtcacataaacgaaaaatggcaacagaaacaggcagttaggtccattttttatatatatatatatatacacacacagagttacaaataggtatttttagaagagctccttgactttactgcttctgttgagtggagagaaaagcaagttttaatccatgctgacatggaaggggaaagtgtatcgagattagttgcttgttgaattttatactgttctattttgctggctatcgtatttttacctacggatacccaatagccgttggtcacggtggaaatagattatgatatttatgatcttaattaggggtctaagtgatccaacccaatcaaatttaaatggttggtttgggtcatttttttaagaaaaaaatgaaattcaatccaaactaatctatttgtaaacgatttgaattgagatggattaatgggtcaaaacatttaattttgtatgttcattttttaaacacaatattttttataagttaaaatttttattaaaagaatcagttacaactttttcttgttaaaaaatttattaaaaaaattgtgatgatatcacacctcattccactttagtggtttctatctatttatttatttatggaaatggaaattaagtatatcatattcgaaataaagaatttcaataaatatagtgaggatgagttttaaacacgtcttaccaaaatcaatgggatattataaggtctattttttgtaaatagattcaaaatatttttagaagtctatctaaaatgattttaatcaataaaactcttgttgttttgatcttgaagattaagaatgtgttaatgtttattcaattcaggttgataagtatatgtaattaatagttaaaaaaatattttattttaaaaaaaattaaaaatatattatatattatatatattaataataataatttaatacaaattaataagttaatggatcgtctatccaattcaaactgtttgagttggattggataatttagatttgctgatgatctgtacctatttatatccttaatttgaatgaattttacttgtaatgttaatgttttgaatcataagtcatcgtagagcaaattttgcctaattagtacctgacttgaggaattattttcataggtatgtctttgggaatacttgaaaaaagatccaaataaataaataaaatacaattgattatcattgtgtggttaatatctatgaaattatttgccaaattggtagttaacaactaaattgaggctgatcttttcagttgtcagctttgcccattgccattcgactgcatatattgcagtaaacttggggcaacattaagtacacaagtatttgtctaacatagacatatatgtttggtcaccaattttggtcttattttttaatttttcagattagatgaaaaaaaaagggattaaattgattttgttttaaaaaaataaaggaactaattgaatatttaaaaaataagagacttaattgaattgttttttaaagtatagaacttaattgaacctttaaacaataagaggatcaaattgaatttagaaaataaatcaaagaattgaaaataattatcaaattaataaacataccgtatattatgatttctcatttaataaccgtagaaaaacttttatagtattagtatatgtatttatttttttatcaaaacaattttacatctcctatattatctattccttaatatatgcaggaccttttttatactatactttgatttattttattttatttaagtgtttatcgagaaatctatccaaattaagatattaatggatccagttgtctctcaatgttacttcaaggaattattcataacaccacaacttccattctaatttctgttaggtcttaatgagaactattatcaagtatcaactgtgatatttaccgcgattcgttcttgctgaatattaggcctcatgctctagaggcaattgtttcttgcactccatttttttttttgcttcttgcaccctcaaatgtttttaaattccccaattatccttcctttgttaccggatggccatttcaaaaagttatagatattcccaaaacctattctaaaatacctattttaaaatatcaaaattgtattctggaataggtattcctaaataagtttctgaattgagcaggtcgtcgcgtgccggtcgggggacggattgggaacgggcccttcggaacctcttccccgggcgtcgaacagtcaactcagaactggtaccgataagaggaatccgactgtttaattatctattttaaaaatatatagagaacctgaaaacttattatggaatacttgttccgtttcatatttcagaacagatattttgaaatatgtttttggattatatatatatatacttccgaaatacttgtttcggacaccatccatcattacactctttaaatacttggataaatactccatggcatactcaaactccttgaacttcctttctaccagattcttctcatcaagtactttcaaccgttcactctccatccaccatttcacctcctttacttccatcaaccccttcacgagccgtgctcccagaaccaagcgatggcctcgcacgagtgctcccagctccaataactaatttcaatcataatatatttttatatttcgtttcattaactcagaaatcatatcctaaaaaagctatctgacttttcatgatgccccccacatgtttattagttttcctttggttagtaacacacaatatacgatttcggcagccaaatgtaaaacaaacctttcaaactccttaaaataaattagctctccctccacaagttaatagcttggtgggaaaaaaaaagaagataaagtagccaatcaaaatgcattaaaatcctatatttgggagcaagagtattaaaaaaataacacaagctttttcacttgcgagtgagtacctatacttcctgaacctttttgaggtcaaatcaaacccacatgcatttgcttccccatattttgaaccaaaaggtgatgcatgtaaataacctggactctgtttcagaatggggaaatccccctctctgcctcattgacaagattaaatctttacaacctatacaaaatttaacagattcagtaactgaagttagaagatgagatcctccattctttctccgtggagtctggataatgaagccatgtaaatgaatgccattacttttttgagaaagtgagatatgggtcttgagcaatggtcaatacatctggtctctcggcctggttatatgttagacaccgtcgaataaaatcctgaccaaattaattgtagatacagcacagacaattgtcaggtttgactttgacagtattgtagatagtaggtactattttctttctacagctaaacatagaaactattaaccatatatatgtatatatttgaggtctttaatggaaacaaccaccttcctacacttgcatatggaataaagttggatagttcttttttgaaaattaccataaatataaccttacaagaaagcatagttgtgtacatcactgaaaatcagaataaaataaaggcaaatgcactgactaagaaatcaaaagaggaaagtttttattaaaaatattattaatacacgtctaccatgatttctagtgcacctcagtgtgatttccaaaaaactttttattttttggttcctcaatcaatgcactcagggggttcgttaacaacacccaaatataaataaacaaaattatgaaataaggccaaagaacaatcagccatgagcagcaattatcagaaaagtgtgcaactcacctttgcctcgttagaaatggtaggtctagaaggaaattcaactttgcgtgccttaataattgtgtcttcgcgaagtattctctcttgtgtttggtcgtgcccaaaaggacgtcggccgaagagcatttgataatacaaaattccagcagaccagacatcaacctgttttccacaaagtgttagaaaatacaagagccaaatgacaaaaaatatgttaaggtgatgatccaagagttagttgtttccaatcccaaccattgtgacacttgcatcaaagtgaaatatcctttgaccaaagtgattgagagtgagaataataacaataacaataataaaataaatttatccttgtctatacaacttagaaatttattgacctttgatgatataagaggtgtcttgctgagctcaaagcattcaggaggtaaatacctgcaaattgaaaaaggaaaagaagaatgcataagatattttacgaaattaaattttggaatctcaaggaaacattaaaaggagcttcaaatgttaagtcagattgaggagagtgaagctttaaacatacaaacttggaccacttcaaattttggattccaaaaaagatttttaccacttaccaatatgttccagctccctgggatgtaagttccataccttgggatcccacatcatcctccactatcttactaagaccaaaatcagtcactttggcaacaccaagctcatcaaacagaacatttccaggcttcaaatcataatggataatcttctgtgttcttttattcatgtaaataaggccttgaaaaatttgaaccatgatgaccttagcctccctttcaggtaatacaggtgttgctttgaggacagcatcaagatccttccctagaagaagaataaaggagtgtcaaagggaaaatgggttggaaaaacactaaatcaaaagaaaacagtgaatcaacagtacataccactacaatgctctagaacggtgcagaatgtgttttgatcaatctcaaaaatgtcccataaacgaacaatgtgacgatgtacaagagtcttgtgaatattatactcccgaattgcatggcgtatgtagctttgcttcttctcttcactccattgagcatttaaaccatgaagcttgcatgcaacatatctatgctctaccaagtcgaaagcctgctggaaatttcttacttcaaatcactgcaaaaaggtatttatttacaattgccaacataggccaagtaattgtctagattctggctttagtttctcaaaaccttgtataatatttggtaaaagaggagtgctagcaacatactttctattattaatttattagttaaaatttattggaaactttaaaatcattagcgggaatatgttaaatattgatacacaattttgagttctaataattttcagcaaataataaataatttataaaagtgtgctagagtgtgttgttggcatttctcttgctaaaataatatcaatatgatcaaatgattattattatactttctgatagttctgatctgaccttgtacacctcactgaatcctccctttccaagaaggttaagaagggcatagcgatgatttagaatctgaaagttgttaaaccgtgaaccatcttcatcccgtatacgtttcatttcacgaattaacctccccttctctatttcatatcgttccctctcccgcaaaataatttcttcttcctgaacattttcctgctatcagaaacataaagaggaaagaaacaatcggaccagcagaaatatcaacttactcttttaaggctagctaatcgagacttgtagatctcatcatgaattagaatatcttctggtaatccagcctctgcatctgttccatcactcttatcttcaatcagagaaaaggaccaaacaaaaacaaaacacacactattaacacatggaccagagtaatgtattacaagatagtctagcagtatccaataacgtgagctccattaggccatcttaagtattacaagatagtctagcagtatccaataacgtgaactccattaggccatcttaaggagcatatggttggtcatgattagtacatatctagtaaagttattgaaagtcaatgtatacaaagtacttaatgtagaaatttagcaagatgtatggaatgttcataccaacaactggcataatggagaagtgaaaaggacagtcccaaatttggtcccatcaacccctcttccccaattttaggtgataagtgctaaaagaaaaaaggaaacagaatttaccagattgttttttcttaaataatttgcgctgccgctcgattgcctccttcgtttctattagttgtttctggggaaaaacaaagaatgatgaggaaaagtaattcatgacataactatgcaaactatcaacataggcaaggtttcgattgcaaaaaactaacagacagaagttatggtaacattgacattatatacccttgctacaaccaaatattactgagaaggaaaacccttgaaactccaaaaacactactatcctataatcgtattcagtcatccgtccaactgaagcaaaaaggttcaggtttaataatatttataatctaagaaggatagtgaaaagcatgttatttcactgcacaaataaaacatgaaaatgtcttcagataatgacagtttaattatattgaactatgaaatgttaaataagaaaaaatcaatttggatgatatttatcacattaaataaggaaagaatcagaatcctaaaaattgcctgttataataattcctatatcagaataaatctcacaataaatcctagttgaatctgataaattgatcacaatcagtaataatctccagtacaaaaattaaaaagaaaaaatcatggaggagaaaggaaatggaacgtacaagctgggcattcagatcctttaaagcttgaccatcttcccaggtctcggatatgacagttccagctctacaattcataattgaactaataagaaattaaaaaaaatgatattaaatataatttctcagttttcaatcgtgttctatagcacagttgcactgcatcgcggctactggccgctctgttgaagcccgtggtgtcgcagatcactgtcacatgtggagcagggagaattacaaccacatttgcggctattcatggaattagctggagcaactttgattaatggttggaagccattgtgtatccccacaacttttaaggtttattttgttttttttttttttttttgggggggggggggagtatttcatgattttcgaaatcgaaaacctattctaaaacaattgtgtccttgtgtctctgaaacatgacccactattctttggcactctctcaggtgcaccttcttggtgtttccagccttgctctgttctgttgtttctgttcagttcactctctcactgctatctgctctctcttaaagattgttttgccctttcattttcttgcagtaaacactctcgcacaggtctttcatgatttaatccagttctctgttctttattgccaacatatgaatgtctctaattttgggtaatttatataagtctatatataagttattgaacttgtaactaaaatttcacagtagaagtcttcccactatctggtatcccactagagtggttttggggtcagctactctgctatctgagatttaagaaatttcttaaaatgatccatgcatacctgattacaccaacatttccaagtctcaatgagtcttgccgtactttcaaccttgcttcttgtctctcagcctttgaaacagatatcagtaagtcagatattattttcattctctgcaaaacagaaggatcaaatgttaatatgctgctgcttaattgatgcatggtacaaagaatgcttatcaaccatttagttgggggaggggagggagtggtagcagagggctcttctaaattgagtataggtaaagtaacatcaatcgttgatgagaaaatcaatgtttaatactttaatattccaacacatgcatgtgcatgtaataccaacaactgatattgcttattttactctctaaaataagaagctcactttagaagagcgggaccctggcagtggcacacttgtatcaacacggagctgtctaagatttccatttcacttttgcatatagaattcaaacaaacaaaatttaagacagccagtactatctattttaaataacatgtacataataaggagtgaaacattttgatagattcgaaaaggaaactttaattacaactaccgagcaatcaaaaactgaaaataatcacaccttaggcttcatttgctgttcatgatcattcagctccttcagttcctgcatatgccaaaatcaaaattcagaaaacatccttctgattcacaattgagagtttagcatttggtattattatacatataccttttctaactgtcgataaagattttgataatcagcggtctcttgctttgatttacgcaattcctcctccaatgcaacaacttttgcttgtaaagatgcaacgtcctcctaattgaatatagagatgaaataatgagattttttttttgaaaaattacaaaccacaataaatagttgaagtatcaacaatgccattgggatatgttggagggaggtagaaatgaaagaagtaatatcaaacttctaattattttcatataaagccacatattcttttaatgaccataaaatttacaggtggaattaggccaaatccgcacctctaatgaagcagaattatcactatgaaactgatcactgagtctgccatcctgcaaataaatatgagctctatagggaacaatcaaggagtacaatataaatgatcaatctgtaaaattaattgcttaagcaatataacattcttgagcttatgaatagaaattcataggaatcaggaaagattccaatttgcataaccaagagctaaaagacgcaaccagacaataacatcaaatagaccttgccaaatacagagaatgatttaaaaaattaaaagacattacactgatattgagtaaccattcaaaaataccaagcagcaaaaacgggcaccaagatcagtgcaacaaatttcctatcagctatggatggatataatcattccttccagcagttaattctttaagccaagaagtttaaatttcaggtctccattaaaaagcagttaaagaagacatggttgtgcaactatgcatccaatcaggtattgactacagatatataatcacaattgaaaagaccagtttagaaagaaaaaaaaaactgatagggacaattgacaaattacaattccattaacaaatatttcatgggagggagcataccttaaggtatacattctcaatctgaccatttgaagccaaaactgttggaggagaaatttgtgctttggtctgatcagtaactctggaaccacggcctctacctgaaccagaactccctcttccacggccatgtttctttctattcacatcaacattaatttttgtctccatggtctccaaactagtttgccttgcatcagtaacaacctgatatgcaaaatattttaagttggaaacaactagacgaccaatttctggacaaaaagtacacttcttactagttgttaataaagtcatcaaaataatagaaatagatgataagggcgagacctttaaaagtaagcaacttatccagtgagtagctgtttttacaaatttcaacatgagatgcagctattctataactatagcaaagagtatatggagtcatgaaaaccaacctcaacacgttcaaaaacacttgtgctgccatcttcttgaagtttttggcgtttctgagtgttggcttgtattaagaattccccaccattctagaacagaaataaaaagataccaacaatctaatcagtcaagttatcataggaatatatttccatacatctaccaatattccaaatcattaataaacacacaacactgataatcttcatgtcaagtcaccatcataaaaacagcagcaatgaacacaaaacataccacctacatttattatatcctaaaccatagataaatacacaaccaatcaaccaccaaaaaaaattaaacaagagaagcttctatattaacattgacaatccctggcaacacaagcgttggttttaaaaaatggtccacggtcgtgatttgggccacaacatcaaggctgtgactgcaacacgaccacaattgggaccgcatcggccacatttgtccgcaatttgccatgatatcaacaataacgacgagaccacaatgcgaccatgattgtcaccgatatttaaaaccttaagcaaataagccaaaacgataacaacaacagtcctcatatatgcaatcaaattcccacacacattgcactatatagggataataagacttacatcatcatcagaatcactggaagtggatggttcagccaaattttcagcagctccaccaaatttcccaacagaaggaacaaacacagaggaccaacctgattgctgagcagtggtggtggaacccttaccaaccatgcgagcttccaactttgcaatctttgtaggcagagactgatctgattggttggatgagttggatgagaaatgaatgagcatgtcatctgacattgttgctgtaactgcaaactgtttggcaacaaagaaaaatgcttctcaaatctcaacccaacatacactaacaacaaaaactaccccaaaaaatcaactcattcagggcaaaaaaaaacggttccttttatttgataaaaataaaatgttgagtataactaggccatacccattcgtgatcagagaggaaaaggtgaaaaaatttcagagacccacgtgaagaaattggggtttatgcaaaggggaaacggcagaagcagttgaataaatcaggtaatcagagaattgagaattggatgtgattgaaatgaaaaataaaaaggggggactttgagtattttttgccttttgggtgaagaactcagagaattaagtgattggaaagagaaaatctagggttttgttgtttgggaaagtggtggaagaatcaaaagcttgggaaggaagaatgaatattggacctgtgaaagaaggaaggcatgactgcaataactgaagagagtaataaagactgcttttttctttttgggtatgtgttattttgaaattgttgtgggctgtttttgttcagaaaaatttctatgggtaaaaattttgggacacgagtacgtgagaagttaaaagggagggcatgaaaaaaggggtgcaaacatattatatgagttggatttagtgtgtgttcgaatgtgatgtgatgtgagatttgtgatttttaaatctagtgaggtattattgtgatgaatgatgatagttttttttgttacctatttgcttttgagatgaaaatggtgctttggatttctttgaggatcctagatttttatagtgaaaatagatgggtgcaattaattaagtgagaaagtgaaatgtttctcattttgtgatatacacaactagaagtgactttaatgaagaaaaaaaggttgaaattcacatagaaataagcaagaataattgaataggttaaagcactaattgatagccaaaatcaggtattctgacatcatgtgtgggtggtgactgctattaacatggatctatgaacattactgtaaatggatcagaagagatggtaacactctttttgacttcgagaagtataagagtatctttaatattagatcttgaaaatagatcttaagtagaagatctaacattcctcatatccaacaataaaacactcatcaagatcttcatactgcagattcagttctatcacaagaactcttaagatttgcccagattttcaaaaaaaatattcatcaatagcagtaacaataaacacacgggagtcaacaaatccattggaatgaagtaagaacactataaacataaatgaagaagaagaaaaaaacaacccagtgaaaaaaaatgaaaaaaaaatactagggagaaggggggttgcacgcatggaggaaaggggaggtggggggtcgatcgcccggaggggaaggggaagcggttggctgcggcggagggggaggggaaggtggagggtcatgacgtaggaagaaagagaaggtggaggaaaggggaggtggggagtcgcgcgcgcggaggagaaggggaaagggccgtggcggatcgggaagggaagggaaaggggttggctgtagcagagggggatggggagctggaaccgcggcggagaaggaagaagaaaaggtggcgtgaagagaggagagaaaaaaagaaaagtgaacgttgaggatgagaaaaaaaaagtggcactgtggggtccatgtggaatggattaaaatttatctaagatcttaaaatgagatttactactaacgaaaaaatgaaaaagatcttgagaaattttcaatcttacatggcactctggaattcaccaaaaagtggtctaagattccaatttaaaatctaccactaaaaatactctaaggtatagtatagaccttgaaaggaatcttgtaagacctaccctcggtccaaaaaccaaaagcatcatctcatcgtaatcaatctcatgataagatctttaagtaaatcgaaaaccaaaatggcaaaacaatctgtgtgaaattatttttagatttatatgaaatttcttataaaaatttgtttagttgtaactcatcatatgtttattaagtatggtatattgttaagaaaagtagaataaccctgtaaatactcttgaaaatatttgtctcgtgaaaaatatttatggttacaaaagataagcttacatcaatgataaaaaaagatagacttaaatcatttttgccctctatagttttatgattgtatagttggcccctcaaaaaaattgttacacatttatcctcaacgtttatcaaatttagcaattttggccttttgttaatctgccatcaaatttttaacaaaaaaattaatgttatatttaagtgatgaagtaacactgacacattgatattataaataacatgacaatgtaaatatatgctaaatgacatggatcatccaaattgtgatcattgttgtaatgtcactaaattactagtgtcacatttacatatatattagattattagttcatttctcatgcatgttatataaatgtcacatcattacttaaatatcatgttaataatttttgaaaaaaaattaacgacaaactaataatggaccaaaaatttcctaaaaaacaatggatcaaaatttctaaattaaaaaaatgtggagatcaaatatgcattaattattttgagagactaaaattgcatattcttaacatttatgggaccaaaagtgaatttaagaagaaaaatatatattggttaatgtttattagattttctacattgactttccatacattgatatggaagcaatggcaaatgtcattaaaataattacaagaagaaaaaatatcttgaatttgacctctttagcttataaacttcatattttacaatctatttgatttatacaaccacctaacaagaattagggataatcatcaaactcctctaattacaattggtatggtaaatgaaaaaaatataatgtgagtgtagagatatgtgtaggttaaagaattgaatccaaatccaaaattgattttgaataaattttacattattttatgcctatatttaattataagttgaaccaactttgaataactttttaagtttgatcaagaattttatagtgaatttattcctaacttatttttataataaaaacatcaaaacataaatcatatcacttcaaaatcaattttaaccaaaatcaattttacaaaattaattttgttcaaaattaattttgtcaacattcatccaaatattataattaagtttttcataccatatgaccaatttaaaatacgataaaaatattgtaaagaatttcttcagtcgagcaatgctataagatggtcttaaataacatgccctccagtctcatcagatgatcagataaataacatgctcttccaatcatagaattccatcgtctgttacaaaattgccaaggagtcttacattcaaacacaactacactctcctaatttaattggcaaaaggcatagagccccccccaccccccaaaaaaaaatagacttgcaggaaattacatcatttccagtatctagtatctaaacatatgtcgtccattttggcctatgtaaaatacatatcaataaaaccaaataatgcggacaataagagactttgcatgcacaggtccaaaggctcaagtctaggcacattagcgtcattcatttggttaaaacattaaatataacacttaacttggatgataagacaaacaagaagggcagttcggggtgcagttacatccccctccccctccccaccaaattcaaagaacgatagtgctgatagatttgtcactacaatgtatagaaagaattaaagaaaaaaagagaatgaatataaatttaagagcttcaaaatgaagttgattatattggtttacggatatagtataatcaagaaagctaccaccagttgtaacttccccaatccatccctaccagagttgtcaaatctagatgttgtgaacctatgatgaaaagccttggctgatcctcctgaattaggggttccattgtgaaccttcctcgtcctagaacttgtagtataacttccactagtaaaagaatgaactttagtactttcaaatttcaatagatggttgttaccagagccctccaactgttccttttggacttaaaaggagagaattctccaggatgctctgtcatccaaccactatgttttgatttctgtaattctgtagaattgtaacttgtaatgccactttcttccgtaagaacctttttttttccacaagctttacccatatcatgaggtgcagacctatacatcccacttagtcaacctctttctggaatctggtagttttgaaatagcctatagcagaattatgtgtaataatgtaccttatctcctgtatggcttcaattgataattctgaaactctgaaccaaacgtgatcgattcctcatcaagcttcttcttcaacctcctccaagttctcaacatatcagcctgaatcagccccctgtaaagggtgtcaaaggtacctttcagaggaagaaacccatcaacaaataatggcaagcctccttccatttctgcctctcacacaacccatgtatcaaaaccgtatacaagtccaaatccgaccccgccccagtctccttcatatcctcccatatctccttcacaaccttgatcatgtccaacctcaaaaacatcctaatcaatatcacatacgtatgcgcgaactcggagcgcacaatccatcctccttcatcctcttaaacattctcaacgcactctccccatccttcctccctctaaactccttgaagaagcaattataagtcgcggcacacggactcacctcatccctcaccatctcctcaagcaacctcagcatcctcaagccacccgcacgaggcgagacacttgattaccgaagtgtacatcaccacattgggacatatccctttctccttcatcaacctcagcttatccagcacgtgctgcagctataaacatgaagcaagatcgaaaagctagtcacgtcaggctcaatcccgctctcacgcatttgatcaaatacctcctctgcattccttatagttctctcaaacctctcctccggctgcagactcaccttccaacaaactccattcaacaaaacgttataagtaaaaacattaggttcgactcctctatcaaaatcatgtcttttagaaatgtttgcgccattttaacgttcccaaacttgcaccatccgtagatcagaacggtgtagattttcacggtgggggggaatgtgtgtttgttttaattgaaaacctcgacggcgagtctgacgtggccgtacttgcagagcgtgtcgagcaagacgcagaagtcttcgggcgtcgttttggtttctgagaaggcgtcgatgtcgtggaaggcgtgtacggcttggcgcgtgaggccggcgcagatgaggcggcgaaagagggttaggaaatggtgtcgaggaggagtgggagagaggggtgttggggagggttttggcgtagtggagagggagagggcgatcttggagtggtttttgaggcggaggaggtgggggtgagggtgataccgtggagctggaggcttgactcggtggcgtggaagggcttcgagaccagttcggcgtcgctttcatcgcgaggtgacggcggtgggagggagcagaagcggcggaggagtggctctgacggggtttgggaaacgccatgatggtgttgtttcagctgttcacgcttcaaacttcgaagtacagtctataagatgcagaattgcagtctttgcagagagagacttctgacatattatttgacattttttaattatccattttcatatgtgaaaatgtgagccgaatagtgtgatgaaaaattcaaatatatatgataaattcattttacggttaaatgtttttccttgactcaaatgtttgtgtttatctcagacctctaaacctaattgtcatggaaaaaatgtcacttgtgttatttacttggtaagagaaggcataagtgggaggaatgacatagatccatgtaataaattagtaaattatcgacgatccaaatgaaagaatcatgcatatcatgtaaataataaaagttatttttattatgaactattatcaccagttatatagacacatcaaataattttaaatgtaatattgagagtgttgacaaaattatttgaaatttttaattgaataaaatataattttttaagaaaaccagacaatgtttattaagagaaaatttaaagtttttaaagatgtttttatgttattttttttattaaaaattatgtctcagttgaataaatgaatgacgacctttacattcaaatggtagatgtaaaaattaagatgaaatatagaatgtgtaaggaaaatgtgaaaaatataagggatataaaatgaaaataaggatatgataatgactatactaataatctatatatagtgtaaaacttaattaaaaaatttaaggtacatctagggactaaaataataatatgtaattaatttcaagaatcaaaatgtcaaagattaattaagttgagattaaaataataacaaattattaaatttagagactaaattaagaaatcatataaaatctatcacaaatgattctggtttagtatattgataagtttgatattaattacagaaaatctaaaacaaccctcaacttttatccaaatttgagagctggtgtaagattttatgtaataataataataaatcattttagattagagtgtatgtttttattttggtgtatgtctcaacataatctaaaagatgagttaggagaaagttatgacataaacattgtttgatttgtttcaaagcttgtcaataaattggataaatacaaatttagtaattgaagtgatcaacaattagttaggtaaaaaaaattattacgtagttaatttattgtataaagtaaagtttgataaatagtttatttatgtttgacaaaaattaaattattttctacataaaaataattgtccaatatcatgtttggtataagttttggctttaaatcaagagctcaacaagtttcatactacataaataggatatgaattataaagtagatttggttagatggaacaattcatttaacccattaaaaaatgaagtggattaatattgttagtttattttacaaagtagattaatccgacgtattctattttttttgtaaattaaggtcagttgatccatttttaatagattgacccattttattattcttaaaagatcttatgataaaaatatatttaatttgactaatcaacctatttaactcattaaaaaaataaaataaactaacattattaatttattttataaaatgagtcaactcaatccatcctatattttttggataatcgacccatttcttatatattaactcattttgtctagtcataacttcttgggggcaattattacactttaaattaaaagtaaaggaggtaataaaaaagacctagcagcgggtgcaataccaaagaaatggcgtttaccaaagaaatgccaaaacgtcattgcaagcattataaaaagtaacgacatcgtaagaagcaaaaaagaagttccctgtgttgcacaaaaagaaaatagtttgttagtcataaatttttagacagtaaacactaaaattttttcttagggattaatcaaccgaaaaaaatcatgctttttctaaacatcgatttacagcgaaaaaaacgaagccaaaatacataatctgtaagaatttggacatatagagtgtctttaattgtgtgtgtatagtaaaatataaaatataatttctgtatatttttagtatcttcgttgggaaacattgtttatcacttttgttagatttatcttcctaattaagtttcttagtttatgatatttaaatcctaaactctaattaagagatccgttgagcctaattatattcagactcataagttattagtaaataaaatgatttgaaaggaatgaaaaataaaaaaataaaataaataatcaatatatgagattaggatcaaacatatatgtctcactaatcaatcaatgaaagtgatagttaataacaattcctaaaaacacttttgttaaaaagaaaaacacttcaaaatattatagtttaagaataattttacaaaatctttttgtttaagataattattttagtttatatatatagacatatgaatttatatatatctataccgttatgtaaagataacatttttataaataatttatttttgtttgtacttttatttgactattatacctttttaattgttttcaaaactactatctcctaatttctttttaacttctattctctctttcaacttattttataagaaatataaagaggcaaaaagtgtttctcattttttttctttatatttaaggttatatgtacttcctttacctataattttctcatttttttagttcctaagattttttaaagaggtaattggaatatgttattttatttttttacatttagtttctttattgtttatgagacatcaacaataagcttggaaacaccatttgtaatagtcaactgcttttcataatcattgactaccaccacaaatcaacattaaaattttcaatatgctttgttgtcattcatacacttcctaaaaaagcttcctaaagtgtcaccattatgaaattgccccaagtcaagtatgctaaattgtaaaattcttaatggatgagctactaaaacatatatacatcttgttggtatagatagtagtgattcattcctttaagttatttttagcagtacaatcttatatttgcacaatatctagatctcactcattttagtattcttcgcctagagtgttacatgtcaaccattttttgtttggttcgtcctcaaagcatactatattggtagagaagtatgctctaataccatttataatgcccttgggagctgacatctcgatgacccactctccaacactttacttagctttctcattagttataaccctttatacttcaaaatcctccgtatgtaaccttctttgaaactcgataaccaactctaacaacatttgtaacaattaattgctttcaaaatcattgaatgttcctcacaaactaacatgagacttttcagcgtattttaatcctactcaaacactttacaaaaaaaattcttaggatcacccatcctaaaatttatcaaagtcaaacacacgtaacgaaggaattcttaagtgatggattagatgcatttttttagtataagtaattcttttaagtaatcatcaacaatacaattccatcttgcacaacctctagatctccctcattttggtgtgcattcaatcggagtgttacatcaacaagtgataacgttaataggttgcatgttagcataaaaatgtaatgttttggatgccacgtcagcaaacacttaaaaaagttacaatgactaaaaacaaaaaacaaattttagggactacaaacaaaaacaaaataattttcaaggactaaaaaaatatttataagaactacaaaaatataatacaatttataagagctaaacaaaaaaaagggacatatttatagggcaaaaaatggatttaagttttcatcaaggcttggcctattttgtttgaaggtttggctagcttggaagtctaattatgtgactttctatttgaaggtttaatccttaatagattgtctaataaactaagatagactttgaaaatgagcaagcaaaacctagattatagctcatgacaaatgctagcgaggcttagctcttgaactttttaaacaattcgacttattttagtcagacatgtctcaatgaagggcaatattgtcttggcactatgattatttgagtgataatcataggtgatggtgtaaatatggttttaggattacactatgaattaactctataataaaaatttatagaaataacaaattatggtgcaaccatcacaaagtctttgatcgagacaagtcactaaaatgggctcttagccaaaaaaaatattttaaatgagatttctttatcattacaactatgactcaatattgtgattttgtaaaacatattttgattcatgttaatgtaacaccttttagaataagctaaatcttcaaacaagacaagccaaatcttaaaaattagctaataacaaaaaaataaacaaagatgaacttttataattccaaaaacatatacctaactatttatcttatattaatatctattttaagattttaaattttttagacatgtaaatatgttattattttgcttttagtttatctaaaaatatatctatttttattttttttccttattaacatgacactatgtaattatagtttttttttatgttatcatttgttgatgtgacatttaacatgttaatcgtcattaataatttctaacattaatgattaaataaaataaataataaaattacgagaccttttatcttatttttataggaaatgaaaatgaataaattatagagataaaaataacatcttaacctattatatacaatataattgtacgatatataatatgatattttataatcgaatatggtaaattataaatatttttttcaacaattcatgtagtccttattctttcgcaatcaactttttacatttggaaacttttcatattttgttcttatctaagtaaagaaatttaaatcttgaaaaaatttaaattcacaattaattaggatttgttacctattaggattaaaataaatgtagtccttattctttttaattgattttttaaatttgtaaactttttcttattttgtttttatctaagtaaagacattaagtcaagaaaaaaaatcaaatggccaattaattattaggattagaaacaaatatacattaagagaagaaacatttttttttcgttggaaattataaaaactcataatgtgtgtattcttcttcttccacaatttgtttcgtataaaaaatctgaaatcctaaatcactttatgaaaaatacaaaaggtaactaccacgacacctgttgttggtttagagacacatccatgtaagaaaccgtaaaaaattccacatttatgaccatgctattatttttattttttccctagttattgattatatagaaattcggcacagaaatatgagaggtgaaataccgagaatgcccaaagccccaaataaaaaccaaggacatttctccctcttgtctcgagcaatagcaattagcaacacagcaatagcttctggtgatctcgttttctcacagtgatctcttccccctttctctctcctctttctctctcttccattgcttctccataagcaacgccacgcgaggtcaattgcgcaatcgccatgactgtcatgactcctgctcccattgacgtacgttcccttacccctcactctgcaactccccccgcgcttccaatcactcgcgcgttttcaatttcgctcgtcgtatttcgttttctcttatttgcttgcatgatttttgttcctttttgctgtctcggctaatggtgtcaattttgattgtcgttttggtggtgagggttgggttgccgcggagtggatgggggtttcgtgttaggggttgtggttttgatctgcgcgagtggaatttgcttcaattacgatgcattccgtgctcggaatttggggatttgattggggttggttttcggtggatccgaagtagggtgatagtgatgatttctttttggtttgtgtgttttggtttttgcagcagcagcaggaggacgaggagatgcttgtcccgcacacggatttggctgagaataatcaccaacccatggaaggtacttgttgctttctcacacttttgatccgtagagaaacccccgctttttctgttactctatttgttggcttttatatgatcgatttaaatagtttcttactttcttaagagttcagggagacacttcatgcgttgtttgattgccagagagacagagagggaataacttgtgacgaattggtcttaaagagttataggttttcctgacaaaaagtgatttcttgtttgattgcattttggagaggttgtgtgttttcaacgactttattgagtgatcgtatcattgtttttctctctctttccttgcaaccgagtagagggtctagtttatttattgtcccccccctggttttcagctgatttaaggcatgatacttagttgttctttttcatttattttgatgattggttagttgtggctcaacctgatgctgccaacactgtggagagtcagcctgttgaggatccttcaacgtcaaggttcacatggaaaattgacaacttttctaggatgaatacaaagaagctctattctgaaatatttgttgttggtggttataaatggtatgatgcttttactctgtctgagttgattaatgatgtgcttatctttaatgatctcttctgaaccttgttttttactgggcaggcgtgtactaattttcccaaaagggaacaatgtggactatttgtccatgtatttggatgttgcagattcagctagtttaccctatggctggagtagatatgcacagtttagcttggcagtcgttaatcaaatccataataaatacactgtgagaaaaggtagtctattaagtttgttccgtacaattgttgcaagatgatgtactgtgtatgtatgtagaaaagatcattgcttgaagtaagagtaaagaaagttgtgggatttttgttgcaattaatttaagaacatttaattcttgaatatatatatatatatatatatatatatttaaaaacatttgaatattattttccttgtaacattggatctaaatctggatatagttatattacttatcttaaaagaactgtaagcattaacatgttaaataaaacaacactctcactaatgaattccataagggctcttgttaagttataaaaaatggaaactatttttgtataatgcatgtaatgtattgagaggttaaaatgtttgaccttttatttaatactttgtattttgaattcctaacaagtgccctaagctaagggcactcattagcatttaccatgaaacagaagtgacaggggaataaagtgaaaatgctcataatttttgtgcatagccatgtgctttgtctaacttcattttacactgtgtagacacacagcaccaattcaatgcgcgggaaagtgattggggtttcacatctttcatgccgcttggtgaattgtatgatcctagtagagggtatcttgtgaatgatactcttgtagttgaagccgaggttcttgttcgtagaattgttgattactggacttatgattcaaaaaaggagactggctatgttggacttaagaaccagggagctacatgttatatgaattctctactccaaactttgtaccatattccttattttcgaaaggtcaggcattgtttctcttattgtttttttcttcagaagttttatttttttactggatagtgacgaggaagtttggatttgggtcctggatgtcatatttcaggctgtataccatatgccaacaacagagaatgacatgccctctgcaagcatccctttggctttgcaaagtttattctacaagctccagtatagtgacaccagtgttgcaacaaaggagctcactaaatcttttggatgggatacatatgattctttcatgcagcatgatgttcaagaactgaacagagtcctctgtgaaaaacttgaagacaagatgaaggtaaaggatgatctttggattttttgtacacaaacttttttgtggaatactgtctcaaattcatgatgattatgttcattttgtctttagggaactgttgttgagggaactatacagaagctatttgaagggcatcatatgaactatatcgaatgcatcaatgtggactataaatcaactagaaaggagtcattttatggtacttccatgtacagactgaaactatgtgtttaattgtaccttgccaattgattctaatttagtttcacatatacttgcagaccttcagcttgatgtgaaaggctgtcctgatgtttatgcttcctttgacaagtatgttgaagttgaacgtcttgaaggggataacaaatatcatgcggaacaatatggtttgcaggttggttgcaattgtttattttggaatctacttgtaataagtcatttgtagaagttctgaatcttttagttcttatattgggtgtacaaaaatcgttttgtttgcaattgtcaagttctgaatcctttaagtttcttatagttgctgtcagaatgcaataatctatacattttttaatatagtttcacgtataaaccgatgatttttcattttttcaggatgctaagaagggtgtcctgttcattgatttccctcctgttcttcagcttcaactgaaaagatttgaatatgactttatgcgggatactatggtcaaggttagtagtcaaatagactcattgctctatatcatattttcttttctaggatatgaagaagttagcattgagtcagagtaatatggtttcgtttcagtcagtttgctctagctcactattaatgccattgaaagttatattgattaaattaattacttattcttgataatctacagtgatatccttctttatttgtggtatgtattcatttacagtactgttacttcatgtaagaaagtgattcggcacgacttgtgctgtacaatagtgtgttgtgatattgaaaatcatgaaggatttctgcagggattttcttaatattaatttttaaatggaaattgtttttttttttttttgcttatttttgctctgggtcttggtgggaaatctttttgtttgtttgtttgtgtgtgcatgtatttaaaatttatgtatgtcatttgaaacaatcagttgaagggatatattctgctagagggattatgggcattacttgttttatttttcagtccatgggctcttctcttttgatggaatggttaaactcccttttctgtaaatggaagtttaattttcttcttcttccatgtagattaatgaccgttatgagtttcccttgcaacttgaccttgatcgtgagaatggaaaatatttatcacctgatgctgataggaatgtccgcaatctttacacacttcataggtaatgtagtggtaatgacagctctgtatttgttgcagactgcatggttttttatttgggctgctcttctagtgatctctcttttcatgacttctttaggagttgtccttgtttcatgatattttatttggtgattgtgatttggtgcatgatgcccaattttgtttttgatttttttagaagccactttcagtatatatgttgtcatatttttacccatttacttagtctagtacaatccatgttccgtggcttctacaatctatagaaagaaaaagaagataaagtaggatgaggagaaaatgatgtgaggatagataatggaaagaagaaaacaatttatctttgggagagccatctcataggccttctgaattttccaaatcaagtgggggattgtatttttgaataatcttgggacagtaaacttggattgttaatgttaaagtttaaaagttaccctttaaaaatattaatcaataaaattcattgaaattgtaatttttctttctcagttctgatgatgtccattagtgtgcaattatttctttttatgtgaatgcatatttttatctgtgatgttcattatttgacagatttaaattttttccacagtgttttggttcacagtggtggtgtgcatggtggacattattatgcttttatcaggccgactctatctgagcagtggtatgtatactctgcttttaggtctgaatttttcagtgccatatgagctacatgtttttgtgtatgttatgatgactactaggggccacatcacatgctttttggattgtgagaaaacttgaataattagctatacccaatgttgtcaaaattgagatcttacacaagatcgtaaattgaaggatcaaaacatggatcataagattctaccaaaaatgctcaaagttatacataaaagtacatgtgataaatatgcatagataaggaaaatatcttgtaaatgataacattgaactaaacttaaagctgaaaattcatattcattgattatatgttacgcacacaggatcatgtgacaaatactgattttttaagggtgatctatagatgaaagtcagaaccacaattaatgtaagtcaaaaacgagctttttattacagagataaaaaagtgtgtcttattacagataaaattataaaatatatgtgatgaaaatgacatagataagtaaaatatttcctaaatgataaaattgaactaaacttcaactgaaaaatcatattcataatttgtagtttgtaaacgataccattattagttgcatgagagtatgttgtatcttatattttaaatgaggcagttgcagtggtaaacaattgaaatgctgaatctgtttgtttgacacttgtcattagattgataatctacatttctaataatggttatgaatgaacttggatataacatgcaactttctgagagtcccttcaccttctttttgttattttgttttgcatttcttgctgctttactgagcacttcactgcatgctttgattgaatattaggtataaatttgatgatgagagggtgactaaagaagacactaaacgggcattagaggagcaatatggtggcgaggaagaggtaattgcttttttgcaaatggttgttgcttgtatttgaacatttacttcttggttatttaaccacttgtattttaacagttaccgcagacaaatcctggatttaacaacactccttttaaattcaccaaatattcaaatgcttatatgctggtgtatatacgtgaagctgacaaggacaaagtaatatgcaatgtggatgagaaagacattgctgaacatttaagggtaagtgactattcttaggtacttttgggtttaaaataaatcaagccaagtcaaatagctacatgtttgtcttctgcatttaaatttaacttgctaaagaaatgcagatggctaatttattttaagataagcatgttctgttcagatacttgatgactgtgctgaagttctcaactgtgttttttattttatttttatgtttgttatctatctatctatttatatatacatgaggagcaacttaccccagtgtaagttacacctactttcacactatttattaacattttggtcagcaattttttcctaaacccatcattgtaatcgaagttcttatcaaatagatcatatttgcaaaattttagattaatccaaaattatttgatacctcattcatgcgggggattggtttgggtactttgcatggggttctagattcaaacctcattgctgccattgtgacccccaccccccccccccccccccaaaaaaaaaaataaccgcttttgaaatatatgaaaataagaattaattgattatcttttgttttaactggatttgacatgaataatctaggtaatatatagttattagtcaacggttagatagatgaacatcacattttatacaaaattgttgatggcgtaagaatagctatgtgtaagttgatctctcttacacacaaaatttaaactctgcctaaaccaagtcattttttgttttttctcacgagaaattccttgggtgtatctcaagccaaaatcaaaccaatctcactttgctgttgtcttttaaatttctgttgtactatttctactgctttattctggaaaatttgcactgaatttctacaatggattaatgcaggagaggttgaagaaagaacaagaagaaaaagagcacaaaaagaaagaaaaagcagaggctcacctttacactattataaaggttcgtaggtggctagttcctaacttgctatcctagaattgagtactgtttgtgtcctcacatagagatgctgtgggttgcttaatcctaaactgttaacatgtgatacttcttaggtggcacgagatgaagaccttgcagagcagattggaaaggatatatattttgatcttgtagaccatgacaaagtgaggagtttccgtgttcaaaaacagacgtcttttaacctttttaaggtatcatcattaatcacccttttagctctcctgctagatgtgttttgacctggcataccctatttgtttcttgtctgatttgatttggtctctagtaaatctctcttgttaagcagttgcttttttgttgaaaatattggaatataggacaaactagttttctgacaaaatgacttatttgttaatgactcatttaagagggagatattgtagaattatccattgacagaaaaatattgtataaatgctgctgactggaaaatatatccaaatacgatagaaatcagcaagtttcttggcatggatattttcagaaaattttttagaagaaagggcacaaaagtgacaagggacacagatattttttttttgatcggcaaaaatattatatatatagataaagttaactacaagacgtattgaaaggcggctggacaagccagaacctatggcaaactaatacatggagaagcatgaattagggagccaaaagtcaaccaccctacagtatatccccaaaacatataggggcagaaatctaacaagtatgccctcccctggaaacaaaattgtcccccaaattacttgaccaaacatgaaatggagtatcaaaccctttcatcagatttttagtccatgaccagcataggaaaatagcatcgtccataatcttgttgcggttaaatagctcattctggaaaatgatgctgtttcgatgtctccaaatagaccacgtcactgctatccaccacacgagccaagtctgaccacataacccgctgagataccaatatgagtgttgattgaagtgcagccttggattgtctgaacacacattcaagatagcgatccatgacatagattcccaccaaatgggtcgaattttatcacagctgaagaataagtgtgctgcatcctcctcgaggctcctacaaaacgggcacaaaaaatcatctagtacaacatttcttcttttcaagttcagctttgttggcagcctatccctgatgagtctccaaacgaagcataatgcattgggaggggctctcagcttccatagcagcttgtacgtgtcacaggagttcaaagatgtcccttccttattgataaaattataggcactccccacagtataccttccactcgagtcagcgccccacagccaaacatctggttgctgtgtgcatatcaccaacccctgtatatcttctaggaagttgacagcagcacctacctccccttccatgaaaaatcttctccactgaagttgccattcccagccattagacgtttgtgcccctagctgctggatgaactgttgctgttgctcagatatgacatacagtcttgggtatttatccttaagagacagtccgtcgttcttccatgtgtcctcccaaaatagggtctttgatccacatcccactttccattcaattcctctactaatcccacctcgttcaccatttgggttgcaaacagcaccaagatccctccaccaaatggattccccacctcttctagatacccccaaattcctccacccaccatattttgaatccaatatctgcacccaaagctcatcctgattgtggaacatattccaaagccatttcccaagtaaagcatggttaaatgtagtgatgtccttaatgcccagacctccacattccttgggctggcaaaccaaatcccaactcacccaagcaattttcttcttgtcatcgatatcaccccacagaaactttctttggattctaatcagactatccaccacctttttggggactttgaagaaagacaaagggaaaatcgggattgcatttaggacagctctgatcaaggtgacccttcctccaaatgaaaaatatttctttttccacgcagctaatttcctttcacacttcttgatcaacggatcccacataacagcccttcttgggtttgccccgatagaaatacccaagtataagaaagggatgaccaatggtctgcaatttagaaaagaagctgcatttactgcccactgttcagtcatgccaaacaccccaaacttgctcttagcaaaatttatttttaagcccgatgctaactcaaaccctctcagcatagccttgatagttctgacattattttctgtggctgccccaagaaataatgtgtcgtctgcatactgtaggagactaacatccacctgtttttcacccaccttaaatcccacatactgatccttcttttgggcttctctcatcaaacccgtaaggccttcagctacaatgttgaagagaagtggagctagtgggtctccttgcctaagaccacattgtggagtgaactcatccgttgggctcccgttgactaacacagagatagtggcagattttaggcagcctttgatccaagaaatccatttaggggcaaagcccatcctttccatcatatagaacagaaattcccagctcactgagtcataggccttttcaaaatccactttgaacacaagacagctgtccttcttcctctttgcctcatcgaccacctcgtttgctataatcacactatgaagtaaatgcctccaataaatgctgattgacggtggtcaataatggaaggcagcacctttttcagcctggaggacagaactttagccactattttgtagacacatcctataagggaaatgggcctgtagttatccaagccctgggggtcatggattttgggaatcaacactagaaaagaagcattaccacccttaggaataaccccattagcaaaaaattcctcaaagaatcgtaggaaatcagatttaagcacatcccaaaattctttgataaatttaaagttgaacccatcatatgattggcacagacatggggacacagcaaatttgaaaaattatagcactaaacacagttataatataaatgcatcaaatcaatttaatattaacatgaaataaaagtcttatatctaaaaagagagttcatgtttgaaaatcatcagttattgtagacacaataaaatgttaaaatttatctgattattatgctattttaatttaatttgcataaaacttaaaaaaaaagtaaaaaaaacatataaatgcatctaaaagtgtacaagtatttatgaagtgtttagcatggatagatatctaacagctatgacatgatacatgtactatttagaagtatctgttgttcttagatgattgctcaaaagacattctattttcataagcttgattttttttaatctgattgctggctcatctgtgggatacgcaggaagaggttgctaaagagtttggcataccagttcaattccagcgcttttggctatgggcaaagcggcaaaaccatacgtatcgtccaaatcgaccattgacacacatggaagaagcacaatctgtaaattcttgagcttgcttgaagcttctctatattatttttctcagatactctcctttgagctttatatcaattgcctgtttaccctgcatttgttgaatgctgaatctgttcttatgcttcatttcttaatcaacatgccaatttcataattgtcctgtccggttgcttattttatattcaatttcgtgggctggcccaacagtttattccctgtgttggttttgcttataagtactttatgcctgccattgttggctaattgttttttatttcctgaaaatgaataaagaaagcaaccagtataaagtttttttcatactatttttggggatcctgtggtttggttattatgccgttggttatgctaacttttctgtgatttatatcttcccgcttttggtacttaattttgtggcatgtctctttctatatgatctgaaggtttatatatatatatatatatatttatattttgtcttttcttaatctgatttgcattgcaggttggacaattgagagaggtatcaaacaaggttcacaatgcagaattgaaattgcttttggaagtggagcttgggctggtaatatttgtatttatggaagttgcataccattttcatagcatgaatcattaatatccgaatttctgtccttttgacaaactatgttgttatttaggatttacgtcccattgcaccgcctgacaagacaaaggatgatatattactgttcttcaagttatatgatcctgaaaaagaggagctacggtactgagtaatgtcttattttaacatgcggatgtggtaaaaggtgaacctttgttgacataagatgtatttccctattgtggcagttatgttggaaggctctttgtgaagagtactggtaagccatcagaaatcttaaccaggttaaataaaatggctggttatgatcctgatgaagagattggactatatgaggtttgtgttctattgtttaatattttgagttgcagaatgccttgaaaattgagactgtagttcatccttgtatgatctaaacacaatatgcttcttgagatattaggcttggatttagcattcttagtttcatttgtttaataattaaatttactgatgattgatgacaaataaagtgcattatgttacaacaaaaatgatctattctgcatgagcctgacctctaaagaaggaccttcttttattattatttttcatctttaggttctgatgtcacgagtgacttgaattgtgtggcatttgtgaattaaatgtgcctactattattgtgcaggaaattaagtttgagccaaatgttatgtgtgaacccattgataagaaatttacatttcgggcaagccaggtaaattataaacaccattgatgcactttgagttactgtatctttggttggtttattgatttgtttttctatatttgcagttagaagatggagatattatatgctttcagaaagctcctgctatagatagtgaacatgtccgctatccagatgtgccttcatacctagaatatgtgcacaatcgccaggtatttttctttttggtgttcaattaaaggcattttgtatggattgatatgcaaaaatgaaactacccatttattcagtcatattattctgccccttcctcctctttcccccttgtccacgcctgcacatatctgtatgtgtgtaaccaatataccatgcaagtttccttatgtttttaccgtatgatatctgctaattcttttatgtctaatttatgtattttaggttgttcactttcgatctctagaaaagcccaaggaagatgacttctgcctggagatgtaagcattgtgtaatttattggagcaaatcattagatttaatatattgcaatattttacttgagagtacatgtaagtatttgtatattattatgcttagatttgcatccacatcttatactatgtatatttttttctaggtcaaggctctatacatatgatgatgtggtggagaaagtggctcaacaacttggtttggaagatccatccataattaggcttacccctcataattgctactctcaacaaccaaagccccaacctattaagtatcgtggtgtggaacatttgtctgatatgctggttcactacaatcaggtaattattgacttgtcccaactttcaacttgtttcttatttataaagcaaaacatcttattcctttcatgcatgtcagacttcggatatattgtactatgaagtacttgacatccctctgccagaattacaaggattgaaaactctgaaagttgcatttcaccatgctaccaaggatgaagtgagtatatagtaatctgattttattttggtttttatctagattattttccatgacacttttttatttgtttattcaggtggttattcataccatcagactcccaaagcagagcgctgtgggggatgtccttgatgatctgaaaacaaaggtcattgtgcatgagtattatttagttcatcaacatgcctaaactgtacatttactcatcactgaaatcacaattacagccaacgtgcactcatggcttcctctgtatttagaaacaaaagatacatgaagccatgtttgtcggttttgttcagtacttcatttagttattgaagtagtaaatttttaacataatgttgtcaaattgtcttttcctcagtttatgctttttcaccttaatttttgaaatatgtcttgtgctcattttttacaggtggaattgtctgatcctgaagccgagcttaggttgcttgaagttttctatcacaagatatacaaggtgttgtgttatctctattttaactgctcctggatttattaatactcttgattattttttctgaccaaaattatttaagaatcagaattcaatatacttaatttagcattgactcatgatcctccaattttttgtgccactgaaattgcaattaactttaggacattagtccaattttcttactgaaatatgttcattttgtcttgtctttctgcttgtgcaggtcttccctcccaatgaaaagattgaaaacattaatgatcaatactggacattacgtgcagaggaggtagtagtctctttctgtttttgagtgggctgggaagggagatggctttcagtccatgaattcttcctgcttttatttattgaaatgattgcaccagtggatttaaatactcaattatagtttcatttatttattcagtttatatatcaaaataaatgtgtcacttttttattggtattccagataccagaagaagagaaaaatctgggtcctcatgatcgtctaatccatgtgtatcatttcactaaagacacagctcagaaccaaatggtatataatttttaattgattcattttgcttactggaatttgtaatattttgatggctttgatatttcattctgacgttagttgtattccaacctttttgtcacttttttttttcccatttgatttgatatgacagcaaattcagaactttggggaaccctttttcttggtcatacatgaaggggagactttggctgaaattaaagtaagaatacagaagaaacttcaagttcctgatgatgagtttgtcaaggtatttcctcttagtgtattctatgggtatattatgcttctttttcaagtaatttttctttgaatgatggaagtttcattgtttataaatattagttagtaaatttgatgttaatttatctaatttttatattatgtttcttgtttggccagtggaaatttgcctttttttcattagggcgtcctgaataccttcaggattctgacattgtatccagtcgttttcaggtaattcatttatacttggattcctttttttttttttgtgataattcaattgatatttagcatcattttcatgtctgaatttatgcttgcattgtatcttgtgatagaggagagatgtttatggtgcttgggagcagtatcttggcttggagcatactgacaatgctcctaaaagatcatatgctgttaaccaggtttgtaactttgcctgcaagagcaatttttattaagtacattttggtctttttaattgttttgtggttgtccactattctggtaatactgggttttagttttgaggttgagagaactttgttttattacaccatttcaaattgcatgcattttgtttcagaatcggcacactttcgagaagccagtaaagatttataattaggaaactggtattgatgagttctcgtcttgcgtgggatgaatttggcatattctgctacatctatgggcttttgtaaaaacagggaaaatagcgaaaggctactctgtataggccacaattagtgagatcagcaatccaagtggtttctgcaggttttatattagaattgtggtatgtaattctttctgtcaacggatctcaacactgtctgccgaccacagcctgttgagctttactacttccaactgtgtggaagttgttcaagttgagatcattgatcatcatcactgcactgtatcagtacataagatttttggattagtgagtgtatacagggtatagttggtcgactctttttttgttcatcttgattgcttccagattttgttcagtcagtagtgttaatttaagtgagggctgctaaatggtgtagcagatttaatgtaatgttgtaaaagagactcgccagcctcggtataaccccgttagcataaaaatatagtttcctgccgcatcatttgctccatctcatgtggcttttttatttcacttttttctgtttcttcgcctcacctagctgttactaatccccccatctcacttaaatttagagagagaaaaaatttaaggcattggtatttgggttagccagttctgcccatttcttcgtttaatatttccattcttgttgggcttagcttaaaaatgataaatttcaacttaaacttctcatacaattttataaattttaaataaaatacaaataattgtgaatgtataattaatcttatgttcgtgtatatcatgggttaaatgctaataacaaatataaagaaacagagaaaaaaaatacttgaagttgcgtgcatcaaaatatatcctacagcaggattaaggatgccattcggaggttgtggccattcttgagaccgggctcaactatttggtttggacaatccatccaaaatcaggcttaccgctcacaattgcttctcttatataaactaaaaccacatccaattaagtatcgcggcgtggaacatttgtctgatatgctggctcacaacaatcaggtaattattaatttatggtttaaatatgtttaaaatgtatgataaatgatcaaattttgttctggattcctaaatacttacaattattgataatgttagaaatatcagtttttgaggtgacatattatctaaaaatttaaagcaaacattttaacatatgactcaaaacaacaattgtttttatattaaaaatttaaaataaaatttaattatttatttagaatcttaaacatatttaagcctttatttatttattgttcaatctttcatcttgtttctcattcaataaccaaacatcttataattagagtttgggaattttggttggtggtgtatgtacaattataattggagaaaacatatatacgtttattagatgtttttggcatttttctcctgtcaaattagagtttcaatttattaattaatgtattaaaagtattactactaatagcagatgatatggcagaaaatgcttctagacagacccatcctaggtgtttctttatgatgttttcagaattgcgtggcacaaacacttgctcttagcaagtaccattacatgctgccctggcttttctttcacaaggtggacagcaagacgagatacacgagatgacaatgtaactaattaggatataaaccaatgttgtgagaattggattcatcattgaatcggtgatgaagaaattaattcaagaattaataatttaattgagattgagttgaagtcaaatcaattttaatactttattttaatatcttagtaatattaaataaaaaataatataatgtgcaaaaattaataataataaaaattaaatttcatttggaagtgttataagtaataatatataacaaatctagtccaacataatatctaaatttatcaacataatgagctgtttgtattactctattttctttgcaattatttgaaaagaaaaggaagatttgtttctaggttcagaatagagcagttagccaattttgttaggagttttcccttgtcgcgttatctagagaagaaaggaaaaaaaaaatttgtgtagtagcctccaacgcattgctacgtccttgtgaattgtgatattacaaaaataaataagaataagttgggatttgaaaatgcgactttttatttgctcaactcgttcgaacaaatagtaacaattattaaaaaaatacaattaaatttagaacttgcaaccataaacctttatctgctcagagtttatagttgtgagatctaaatttgattgtattttttctttttaatttttgggtcttagttcaattgtgtttgattctgttctagaattggtttggtgtttttatataaacttccctcctttgtctgttgattgtaagcttgaaaaattgattttttttaattaaaaagttttaaagcaacgaaacgtgcttggataagcaacactaggtcatttgttccaaccataaatcaagttaagcacaattccttgactttaagaaacctagactaaacaacgccggaaatgctcttaaatgagtgaattgtggtttatataagttcctttgtttacaaattgaaaaagaagagtattaatggtatgtttggactgttagccgatattcatctactaaatttcaatcttacaccaaattcttgcaaatcaaaaccgcagatggttttaaagaaaattagtttaactttaactaaattttagttgcttgcatgcctagaagtgaaggataataaatatgacgaataggtagtttaatattgttgctatgaggaataggctgtttaattatttgacaatgacatgtactaaaaagtattcaatgatggatttggttatttgcgcgtctaatttgaagtgcgggatgattttatgcaaatcatccctacaaccaccgaatttgtgttttcaattgttttcaagattttttgagtgttcacacgaacatggatcgcttgaaaaattgtatcttagcaattagcatgagcagtttaatattgttactcgacaaataatgggatgatgaggatcctttttacctgtccttgaaatagatttttttttaagctctgtttgatataacggaaagtgactgcaaaaacacgtggtccacagttttttaatcgatccactttggtaaacattatcaaccatcagatctcaaactgcactatgctagaaaacttgtttcacggatcagactgtcaaaatctgacctgaatatttctgttatatacttcattgaaaaattctctagattttgatttatataaagaaaaaaaaaaaagagtagagttcgggtatcatacagcagtgccacctatagtgaacttcaagctatctaatgctctggttttatgctgtaatacatgagattttcatcaaattgcaattcactcatttggttatttacctcaaaactccaataccggtggcctttaatgctcatgagaattgaagtgccattcaagagaattagcacgaattcctacattaattgttgagtattcttttccgtagatgacaccaatgatgatgatgcattgatgcttatagacccacttggttaacttatccttaggccttagtcatgaatgaattgaagctattcctttcggtccatgcataccaaattatcaatgctttaaggctgacctgagggtccccttgaggtgcgatgatgacactgagtctatgattaaaagggcctcaaaattaaattaaattttatagttttataataatttttataaataaattaaagttgttatttattttacgcttcaatttttatttaaattaaaatgtgttaatgttattaaaaatgaaaaaaaaaacgcaaataatatttttttaacaaaaattatgaatttgagactgtttggaaacatattacaattggacgtgactaaatctgtcgctaattatgtctctaattcggttgctaatagtttttgcgacagaatattatgattttttattttttatgtttgcgatcacagaattccgttgcaaacactattagcgactgaaataaagaccaaaattgacgtgttttaatttttgacgtaaaatatcatttaatattatttattattaattttatctaattttaaagtatttttagatcgatcttcatcatagatatgatattttttacttttttaatattattttaattttatatgattttatttaatatattatggatttttagtatatataatttttaatatattattttatttaatataatttctaaatttttatatgattttgtttaatattttttggattttttatataactaattttaatataatattttatttaatataaattttcaattttattttggaatttgaaaaaattgaaaatttttattttttaaattgtaaataattttttaatatataaagtattttaaataaaatattatattttgatacttctcattttttatatcgagaccatcccattaaacacattatcctcatccctctcatcatctctttcatcctttcataatttgataattctctttcaaaaaaagtagaagacaatccaccttttctctttttgttccagtcaaaagcatatagtcgactaactcaacatcgaagttacaccgaaattcaggctttctgtcaatcggtgactcaattgtataaaattagtgtggttaaaacatagacatccaaacaagaaagggaattagaaaggatgatccatatttcatggtgaatgatcaatcgtgcgagtaagttgggttctgtgatccctttctccatcatcgtcgccatctttatctctctgggtaagcgcaatgcaatttgattcactttgtctaatgcagttccacttctatttttagagttctacaatatttcaccactccaagtgcgctttggaattaatggggtgctagaattccaattattgtgtggtgagtgcactttgggatgagtgaaacgagtggtaaagtgtggaaaagttaggaatgaatgtgctttgggataaatgaggttattatataaaaaattcaaaaaaatattaaacaaaaccatataaaaatttaaaatattgaaaaaagttacaacggcgtacaatatgtttttcaaatggtctaacttttgatagaaatgtccgatcgaagtgtacgatatgtcaaaactctcgaaattaagagaagtaattaaaataaataaataataacattaaattaactaattaaataattaaaaatagaaaacaagaaaatttttggatgattgaaattaaatcctaattttgaggtacttagaggcattttttgaaaaaaatagttaaccgctcagggtttctcctctcaatttcgagtgttttgacacaaaatacgcctcaatcggacattcctataaaaaattatgacctttcgaagtttatgtacacaccgtttcatggatgcgtgacatgtgtcgtcacagggtgaaacacgcccaatttgggcgtgacccagaggggtaccacgcccaaattgggcgtgacaagtcacgcctaatttgggcgggactaactgccccagatttgtaatatgtttccaaacagtcccaaattcgtaatttttttattaaaaaagtattatttatgttttttttgcctattaaaaagtgacactcttttaattaatttttctaacattttacaatcatagattcatatcgattgaatttttaattcattgatatatcaacatattgaaaaaacacaaaaaaaaaataaaattataaaatgaataaaactaatattagtattttcataaagaactaaatatatgtaaactttaatatgaaatgatattttgtcaatgatagatgataatgatgtagatctcaaattttctttttgaaggaccaaatataaaaaataaattaaatcataaatttaattaatatttttaaaaaatataaaatttaaagtaaattggattaaaaaatataatatgatctcttttaaattattcttaccttttgcatggacgtggataaagagagtcaaacatatctctccatcttgtcccttatttgtcatgtctacgttatatataaatatttattcgtatttaaatttttttagagatagaaatagaataatagataataatataagagtatcttaaataaaaaatatgatatttttttaaaatttattaaaattatgttatttatttagtgaaataaaatgtatatttgttatgatattatatatctattttgtcataaaatctcaggacctaccttgcttgttataagctcctgcttctaaatttttaactttagagctccgaatcagaatcttttagctaatattttgggaagagcagtatgtcaacttcaatacatgtttctataacaggtacacttgaagaaggttttaagtcaagcaccctaaacttgtgtgctcatttggttgaattactgttaaaacttcatcttgagaagaagtgacaaacataagttaatagttgtgaataggtagttaagtagttaatatcctcgtatacattaaaatgtaagtgcaaatttggttggattaccgttaaaacttcacccttttttatttcattttttggatcttataaatttttgaaatatgcaaaactaaataataagattctaatactattttttttcctagcaaaaaaagaaagagtattcattaaagaaagacaatatcgatatatcggataacccaacaaatacaatttatgtatacatataaaaacaattcatccaataaataaacaagctataactttcgatctacacaaaaattaacaatactaataattaatatatattgataaaaaaaccaccctatacaaaccaatcccagaaatacatggatccgaatattgtgtcagacaataaagttgatttcaagaacaattgctacatatttgctgtgtgaatactagtatgatcaataattgtttcattttattagtccaaatatttaccaatatcgttttaacttccaaattaatgaaaggcgcctcccaaaggtgccagcttttagagcattagaaggctattgttatggtgactttgtcttatttattttcactcaaggaacctcccaaggggacacattggcctgggcgcatctacgatcatcattcatcaaaaattaataattggactgagttggttagggatagttgtttggagaaagtatgtaatggggttaggggaaaccaaattttaaattaaaagttcagttttaatcttagctcgtactatggcatgcttgacatacaagtggtggctattggctagtaagtttttatctttggagattagaatcaaagtttttgagctaataacatcacatgtgaagaccactcattttgatatttacgatcatcacatttttttcttatttgtaaataacttgaaatacatcacgacatgagatttgttacacaaaggacagaagttaaaactacagaaaacatacaggcactcacaaaagaaccatattaaactatgggtaaactgtttccttcccctatgatttgtccttttcactcttcattaattaagcataccttcaacaagtctcgcgagccattgtggtttcccagtcatgaaaacattatatcccaaaagcattccaaatagcaacccacatgcatatcccactgctacagctttccagccaaatcctgattcttcatggtgaaatgttgaatgtggtggccaatcttcattcttattgcaggattttgacaaagggattccacatagcattggatttccagcataggaatcatttccaaatgtgttaaactgtccacctgtaggtatcataccctcaaactggttttgcgaaaggttcaacacagccagaaaattcaaattgatcaaagccacaggaatctctcctttcaactggttccacgagaggtccaaccattccaaatttcttaaattaccaaaggatcgtggtatggtaccagtgattgcattgtgcgaaaggttaagccctttgagagaatgcaattctccaatgactttcggaatttctccttcaaacatattttttgataaatccatggttgtgaaaatagttaatatcctctcgaactccatgtatcgacctttcattacaaccactactgaatcattatagaaatcgccgttacgcatatatttcaaaccagtttgggtgtcattcacactcaccattccttgaaagttcttgatgtatgatgctggcaagggcccactaaaattgttatttgagacatcaaaaattctcagcctgggaaatggatgcttggcaccgaaacaagtgatgacaccatgaaacttatttgatcgcaaactgagtacctgtaactgctggaggctttctagccaatggggaaatgtatcctctatgttattggctgccaggtccaaaacttccagatttgtgcagtgggtcaaagaccttggtaatggtccatccaattggttgccattcaactttaaagtctccaatgcatatccgttagaaaagttcccaggtatgttgccgtaaaggttgttcttttgcaaatccaatgcccaaagaaaaggaaatgttcccagacattgtggaatggtgcctgtcaagttgttatgagccaagttgagtatcatgagggagcttgcattgcacattgctgaaggaatgttcccggtcagctcattatttgagactaaaaagtatcgaatggcattgggtggaattgggagatctccttgcaacttgttgaaactgaggtcaatatgactaatgtacttccaggagtgcaagagcttctcttgaaaccacgggggaatgcttccacgaatgttgttatgagaaagatctagtgagatcagattttgaagtggtgctaagaatttagggaaagtattaatattacaggaagataaatataagaattcaaggttgggtaagatgtagtcagcggtactatcaaagttaatagagagaaaactattgtgagaaagatcgaggtaatttagattttttaactttgaaaattgatgaaagtccagatgaccactcgagtcaattgaccccgtgaggcggttgttcctaagatccaaaattaacaaggaaggcaaagaataacaccaacgtggaattgttccatttaacttgttttcagacaaatatagaaactgcaattttgaaagtttattgatttggcttggaattggaccctctaatttattatgccttaaatctaaaagggagagttgagttcgaataaacaatgatgagggaagcagtccatcaaaattgcaaccccatagctgtagtttgttaagagacttcaaatggccaatggaatagggaatgtttcccgagaaagcagtaaaagagagatccaagtcccttagtggagtactccagtttgactttggaagttcacctccgaggtctttattaaaatccaaatatagtttttgaagattgggtaaacagaggatgtcactggacagattcccttgcaattttgtgtatctaagactaagggagatcaaagaggaagagagattggttagcaatgacaaagagctctctccgatacaagacatgtccacgccatctaaattaagctctcttaaattggttgcgttttgaatgagcttcttccatgtgtatggatcaattctcattcttgggtggttgggatcatcatttatattgtagtcgctgccgagatcaagtgacagtaatttggacaagtgagagattgtggagggaatgtcaccaaaaaaatgattataggataggtcaagaccaatcacatggcctgagatgatgtcgcactcgaccccaagccactcacaacaatctgttccgttgatcccaaaataataataatttggaatgttgagtgagtatttgagttgtagcaagacagagctgtcatcatggttgcagaaagaggaagaagaagaagaagaaggaaggaaaaagaagaagaagaagaaggaagagaaagtatgggagtagaacccaccaaacattcttgttcatattcatcctttcaactcaacaacaaaactagagacgattttttgatagaaccaattcaattcacaaacttctatttataccctacgctgcttcaaagcctttcatttcgatctaactctttctttgctttttcttccttcgcctgtgatataataatatatttgtaaatcattaccaaaataattttgttacttagataatatttttatattgccaacaattaaaaagtctaaacatttataattttgctactaattgattatcgtgacaatgtttaaattaattatagtttcctctaaatgtaaattttttttactccatttatagtgtttttggtttattatagtctttcggatgaaacacgtatactgtgatattttgaatatatctaagctctagtctacaaatatccaaaatgagatccaatttaatagtgcttttgttagaaccatttaagctatctacaacatgcttattataatccaattcgatcattttatttattctcttaactctcttttctgtctttacttttagtttcttttaatttaggggactaaaacaaatgaaaattcctcttaaagaactaaattatttatacaaagagaaatatttaattttatttattcaaaattatacatgttattacattattatttttttaaaatacattttttatccttccaattatttttttttcttttcatccttacaattttttatttatttttaatacttaaaaattatatttattttgttttcagtctataaaatacttgcaatagtgcctgtgaaaaaaaattatctaaaataaaacaaagaaaatttggaaggattaaaaataatttttttacaaaaactaaaagcataaaaacactaaattataaagactaaatatatatatatttttttaaaaaaaattagttgtcaaatcaatctcttaaaaaaattcttcatcactaatttagttctccaatgatttgatgactaaattaattctaatttaatctaccatcaagttaatttcttaaactttatatgttattacttttttcatttcagttgtcacttttctagtcttgatcttgtcaaagacaggtaattttttattttttatttttttataatgaatgacgattgacatatgtttaactttttagattatcttctacaaggtgtaaatattagaatcttcctacttatttttgaagttttgccactcttttaaatgtttgaggacaaacaatttgtttaactttggggtatgagttggccaatctaacctacttatttcattattatcattaattttttgtactcatgtatggtactaagaggaaaaaatggttgcaaaaaatacataattgtaatatatataaataaaaataataaatattctcgtcattaattttgttaaataataaattaaatagataaataaattaatcgaataaatacacgatatttttattaatataacatgttaagtttcaaaatttaattgagacaaaaaagattacaataatttttatttttattttattttatatagtttattatcttaaattaaaatttaaatctaatttaaattagaattaattagattgaagtatttgtattgaaaagagataaaatgataaaaatattcaaataaaaaatttagatactatataaaaaagccacgtaacttaatgtaaaagagaataattcataaaaatactctcatttaatagtagaattcgaattatagtgcaaaaacagattaattacaccaagagttgtaaattcattattcaacataactataacaaataattaataaaggttactaaaattgtcttctattttttttttcttttacgaagagaaatattcaaatttatttcttcaaatttttttatattacaattcttagttttctttttctttcttaaaaaatcagttaacaaattatctcttaagatttcttcgtcattatcttagttctccaatgattttataattaaattcatatttaaaagtttagtctatcatccgtaaaaaaaattagtctatcaccaagttcaagcctcaattttttatgtaactacttatctcatttttttttaatttctctggttcgtattttttgatgacaagtaacatgtttgataattctttaatagaaacttgtaaagcgaaatgacaaatattcaaataaagtctcttttgaatataaattataaatgtttttgaaagttttttttactaaaaatataaaaaaaaattataaaaaagttttcataaatatttttagtcttatattcaaataatttctatgtagtaataatatgtatggaccataattataagcgtgaccaagggttgctcgctttcttattcccatttcgtgggtcattttttattttattgtgttttgcttactgtttttggatcataattatattgaacggaaatcaaaatagaaagaataatcatttttgaatattttattttgctaaacacaaaattaacactcattatttatctctatttttctttctatcatgttacttatcataattatatattacatatattatctctttcttagaaaaagaaaaagaaaaagatgagaaacttacggaattgaccccgtgaggtggttgtcactaagatccaatcgtaacaaggaaggcaaagaataccttcaaggtggaattgtggaagtttattgattttggttggaatggggccaagtaatttattaaatgataaatctaaaaaggagaattgagtgagtaatcaatgaagatggaatcagtcaatcaaaattggggatgttgagttgagtgaaaattaattaaaacgcaagcaacacgacccagaccaaaacggagtcttcccattctctttgaaagttttttctcggaaagtcttagaaaaaccaaacatttatcatttaattgattccattttataataggaatattcaaaattaaatcaaactatttataaactgtcaaatcaataaaaaataagaatcatttaaataaaaattacaaaaataaaatataaaattgtatatttttataatttaatttatttttaaatcttatcataaaaaataaactaaatcaaataaattatatattctaattatattaatttttattatgataaataataataaacattaaataataaacattaaataatatataataattatgtaaatttagttgataatattaagttatgataatagataaaaagataataaaattatgaaactaaatcaaaccaatcataaaaaattaatatgattcattttaaatttaatgttattcgaatcaaataaaaatttgatgaatttttgtttaaaaatctaactaaactgtatcacttacaaccctggcattttctattcaaaatttgcagaaaattaatcttgtcctcatctactgtaccaaataatgaaaagatgctgatcacttttagctaaggcattatcaattatgataaactattatgtcaagttccgtatgtttttctggtacaagaaggtttcaactaaagcccctatgtttgtatgcacattctctgtaagaagagactagcatgctgctcaagacctgtttcatccatctcgatgctaccttaattagtacggcttctagtaaacaataaaacacaaattcagcacaaacacttatagcttagagtttcactttattaatttatgtcttgaacgtgcaaaagaaatttgagaattacctgggttgtgtcagtttcaacctcaatcaatgtgtgaagaaccctcatgggttgctgattctcaagcataagtatgtcacttttgatatatgcatgatatacaatttcccgtgtttaccatagacaggatcattgtcagcataatcatccggaacactatcattggctctcaaaatctacaacatgtaacagccatcaagaatcatcagttgcaggaacctcggcgtgtcgtgcatccaaattggatctagcggactgtacgagtctcaactcttcaaccacttgatccatgcaatggaagatgagctcaataggctttttgcgcctcttgagaaaatggataggagctcggtgcttgtgctcttccatgaacttcagatgctcttgaccataatggtaaggaccaaaggacactacttggggtttgcaggcctttttgttcatctcagtgacatgtgagggaattttgtaagtagaatgcgtctcccattgcttctcaggtgctgtaggaccatcactattgagctcctcattgatttggaccacccattttgtttctttcatatattactgtattcacattacgtgtctctctttgaatcatggcatactagctaggttaatcattctgaatcttatagtaatccaagcatatgtaaagcaaaaataaaatgtggcgccaagatgttattgtcaaattaaaatcttcttttcagttttggaggatggcgcacagaaggtgctgcaccgcaatagaatcttcttttgaacaaaattaaacatgattatatatataagtagtattactactcccaacttggagaaaaaatgtgtcaacttcattcatagctaatatatatatatatatatatatatatataacattcttggcccatctctaaatatattcttcacattaaaggaattgttgattcattagttaccattagagagttggttacagatcaatagattgatgcaatccatcatccttgaaaacaattgtcaggagaatacttgttcgtaatgatgtattaagaaagtcgataattctgtccaaaaaaagaaagccggtaattattattatctcatattaaggaaagttgctctgaagcattacatagctgttttatacagctgcagttaagttgtacctttttacgtacccatcactgttgcacctttttctattgggtgcctcctttttgttgggctatatgtggtccaaacttgaaatcccaaattaaagcttaagtctacgtcctttattttgaatcaccattattttttatccatctcaatgttagttattaaatgttaattttctattagtgaaaacttcaaaatcatcaagtccacaacttctctctatgcctttcttcttcttttatcattaagcaaaccttatatttccttcgatttgtatcaccataatttgatattattatttaattagaaaatatgtaatttattttattaacattttaattaaaaatgaaattgaaaattatataaatacttcaaaattaacttaagtagagtaatcacaaaataaaaaagctaataatgatacgtgtgatatttaattgtattagtttggtttggataccaaattaaacaaaaaaagtaaatttatatatattattttaagtttttttacatctttttttcttatatagaattttaagttttatatcactaaattaaatatttttaatattcttagtatctccagaaaataattaaatcaattccaagtattgatattttttaattaatatataactttttcacatctatgactttatatatctcattaatccttctacttaaaacatgcgttataaaaaaaacttaaatagtaagcataacttaagatacttgtaaaattagataataaatacataaatttgaaagtttaaaaataaataataatttaggtggtgagttaatttaaatttaaatagttaaatatacgaatcaagccaaaaataattgatttaatttgtattacaagagaaataaaatcaaccatgtaatcaaactaatatgaattcatttaatttttttttttagattaccaaatttaatatactaattcaatatgataaaccttacctaaccacacaagaactattgtttgtaatcttctttgtagtctttttggtcgtgtaaatggctaccatttaggttaaaatagtgaagatcagggacacgtacgaaatggggtgcttaggtgaaagttcattaggcctagactcatggcaattcctacttaacttatagtctaaccaacaacttaatatatatatatatatatatatatatatatatatatatatatatgtagcacttcaatccgagtgggttgacttatctgtaatttggaatcataaagattaaagacaagtaaactttgttcaacaaaccactcgagtgacttctgatcacagtcacaaacaaccgcacaaagtaaaagatgccttgcaggtctagtggacttgatgccacacccaacgttgctactactccaacaatatatacacatttttcaaccagcaaaatacttatgtttatatatatatatatataaaaccatgtgatgatctttcaaattcatgaaacgttacttgcttagacatatgagctagagttgatcatattttctgaatttcactaatttatattttaattagttttctttctctttaattagtccaaatattgtggatattgatgactagcttgcgcaagcattgttcgaaaggttattcagcagcagatattagtataatacaacattgatgttaaatcgagttacctcgaaacacagtttggtttgttcgatcctcctaaatagaggtaagtgcatgtgaacccaaacagtagggaccgttttacgttgttgcagatatatatcggggtcagcttgcagttgcaagtaatccactcatgcaagggctaattgaaaaagtatatggttttccaactcttaagtgttgacgcaacgtacctcaatctggccatgcatgtgtttgtacaattgcaaaggacatgaactatatatgctccggtttgtattaatttttaatcgataataattggaaagcaatttctttcaggctagctagagagatgaataatgtacaacctatcttatcatatataagactttccatacaactatgtatcaatcaaatatagtctggtacggtactggtaaattattgatgtagtatatggtcttcttttccaagtaattaacgttaggtttttctttattcttttagataattagatttgtctttataaatataaccatatatatatatatgaattacgtgatgtgtggataaatatataagtgaaatctttaatttagtggtgattaaaaagtatgttgaaatatattattttaatttattagtttttgttgaagtgagatgaaattttataatggataaaaataaaaaagttgagcatcgaagagaagatccataaatttaaattttaatattttatattaaaaaatggtgtcaaatttacttatataattgatcatgacttattgatataaatattttcgatatttattccttgatttttcaacagttttaaatatgatttctttcaactatgtaatgcaagtttattatcgtaaatattttggtatttacattaaaaaaatatttacaagaataacctaaaatttaaaatctttctagcataatccaactatatatatatatatatatatatatatatattcagttacttcaaaagtaattctttaatttagagtcatttatttttttataatctgatcaataagattaatgacttattatagctattagattttaagaaatgaataatgatgatgagaaattactgagtaagttaatttcttctctctttatatatattctttgttgatatattatatattttagtaaagtattactcaagaatatctaatcttattagaagtttgagtacatgatgaatgattagtaagttcataatgtatgagtaaatcattatattctcgagaacacgtactcttgtacaatatatttttttcaatatatatttatattttaaaaacccaattttagtgtctcattattcattaatacacgcaccaagtgaaacataattttaaacacaccattaagaaaataaataaattgaaatgaaccaagatatttaaaaattgtttaatttgtctagttgtaagagttgatattaagttttacataagctaaatcacatgttaacttagtatagaattcaattgttattaattttaaagttttataattttgaccctttgaaatattatttattttacatgtaataattatcaataaatattaattatgtttttttttttataatttaggcaacttgtattgagatttaacacattacatgtgttacctctgattttttaaactctacacaactttccgtaatttatatagcataagactatatatgcctcccattgacacattttttcctaatttctcatactgttatatgttagtataatgtcgaaaaggaaatactatatattatgtgaagtgtgaacgggagggttacgatgctagtgtatgttcagatgtgttcctctttaaggcaagtttgaaagacatatatattataatttatgtgtttgaatgtccttaatttttaagtatatatagttaatgatacttgattaactttgcatgtgaggataaaatcttcacacatgtgcttatatatattaattataaaattaagataagtttaaacttacgtacaaatctgaaatgttcaataattgaatccagagactaattagcaatttgttctatatatgtataatggcaatttttacttggttttgacagaaggtacaagaggagacataagtttaattataaaccataatagtcaacgatacatttgaaaactattaattattaatatcttataatttagatttaattcttctgtatgtgacagctatgaaaataatactttgaatcaccatgaaaccactcattagtttctaataatactcataaatgtcccttacataagaatagtagttatatacattatgaataaaacatgtcgatgaacttgaaatttggaaagaaaagcataatatggtatggattaactccttgtgtggggtcattccagttggaatatcagctcatttcatttttcttgaatttgaagacgatacgataagcattgttttgaatttgaaattaaaaaatattagtgttgtattaatgggtgatgaaatttaaataatttattttaattttttatcttatattaattattctttaaaatgttacattataattaaacaacttatatattttactttaatgatataattttaaataattcttaaattattaattctttttaatgattttcaaacggcaaaaaaaatgttttatttataagtaatcagaacttaattttaaataatctaatataatacgtaaaccatttttaatgataaaaaaaataaacaacaatatttaaaaataagtaattcgttaaacaatgaccgctaaaattaatcttacataattagatttaattactcttattacactatagaatagtaaaattgataatataatgcaatttgtcatgccccttcaaaagtgggtgaaaaaatgcatatgctcccataaacacatatttgaaagtttatctgcgtttgtgggcggaccacagaatttcagtgccatcacatttttaatttcttactttgtttggatgagaaaacaatagctttgaaccgtacaagcttaaaaagtgcatctattgacctcttggtattatttttttctctttgaactttatgaataatataatacatgacttgtggttttctcgcacttcatattgaagatgctatatatgaattatgataaaccactaaacgtaataaagaaggatcaccattttgtttgttagcaagataatgcaaataactttccgccaaggaacttgcatttcttcttcaaatcaatatccctttctctaaactactaattgtcaatcactttattttcccttttggaattcttgactattgaattgtctccaacatttaaacttgaattaacgcccaacctaaccgccttaactataaggcatatacatacctttgcttacagctttgagtgtaaaacagctaagtcacaacacaaaacatgaaagtagtacttcttctcattatttatggtttcatcttttgccataccaaaagctaaaaagccacataaaaacgagttttcaccgagacgcttcaggatgaagccttttttggcctttccctattctcacccgtgcaagaagatacatcaatatccactagatttaacattgacaattcgtgctcctctttattggcatgtattttttctaaatgatactttttttggtctagtttaaatatatgatactataattacaggcgttatacacggctcaatgattcaatacaagactattagcattacgagacccataatctattgtatcttgaataatagaagaagggagaggttttgattggtctgttagcggaataagtcaaatattttttaaactattcataaagagattacggtatcattacaaatatctttttacttttaaattagtcaaaaaaattaaaacgtctcccatttatttttatgacagactaaagtagtattttttttctaaagaaaaagactaaagtagttatcatgtttttttggtatttttagtaccaaaaaatgataaatacaataattatttcaattatttgaattattaaattagtaataaatatcatcaaagtattatcaacaaattaacataaggttatattcttttaatcaagtaatctaaacttaaaatcttgactaatttttatgtgtgttcttcattttcgatgaatattagtttttatttttgataaaattacttcgtatcaatataataataaaaaaaattattaaaatattattataataacatactaatatttaaaaaacccaattttaaaaaaaaaaaaactataattcttacataagcttgcacagtgggtaggaattaagaacaatatatagtccctcaaaatctacattttgacttagacccagcaaatacggatctacttaacctaccttatggaggtgtgtatgtgtataaccttaataactagtactctagctagtatagttccctttcaacatgtttattattttaattctatttgattaattagatagcagcactatttcaatgccacatgcctctcgctgcttgctgttccaacaaggccaattgagtgcgtcggcgaggtttgacttttcatgacgaaaaagcccctagcatacttcgcgtgctttcattgcattgactctttcagaaacaaaaaacaggggcattttggtcattcgtaatgcaaaatcaaagacccttctctttgccttcaagctttcacatcatatatgcacctcctatgagttcgtgttcatttttctatgtcactttctcattgaatattgccaccacaccaccacccccacaaccgtcattctaggccccctgatccccatatctatcattgaccatttgatcacaatcacacggcaattaggccatgccccaccacccaaactcacacggaaacaccacaattgttttcataaatatcaccagatttagtatacacatgttggacctaaccttgtccatataaatatgtacacaacataaacaagcctagcctacaccaaacttttgcatttccatcactctgtgtttgtttctccgaggccttattacaaaaaaaaactacgaacatgaaacacttccacttgttcctcttcctcgctcttctcttccttacaccaaaaattcatgccattaggatcaaattctcaggcccttcaacttcaagccatcaagattttcatccgtgggcaaattctccaatccgaagcagcagagaaagagagaagtctgagaaacgcagagtgccaacaggatccaaccctttacacaacaagagatagatagcttgatctctctcagattttggtggcaacagcaacatatatagtgtaatcagatatggtttctttcttattcactaccttctttgttatatacagggaaatacaaatataatatatatgttatattatatgctagcagaattcaagttgcattttttaagtcatgttagaaatatgattgttaattaattagctagattagtggagagtccttgtacagaaggtaaagagagcattttgagtttttaggaagtatgaaacaataaattataaattgtagtttgtgtatgcagttttatacattttctttgccttaaccaaactttcctgttttattgcaattgaagaagccaaatttttttaagatcgcaatcgtatgctttattcattatacaatcatagttttgcttcttccatggctcaaaatcaaacaagggtctccataattcacaactggttgcatgtcaaatgagttacaatttcttgggcaaccactgctaagatttgaggtttcgttggtcaaactttgggatccaccatcagacattagcaaacatttttcaattttcttggtcctcctctgcctatgtcttgaaaacaactgttgagaagaagaatatagaacacatagttgactaacaggttctcacagattttttgggtttcgcatcgattcaagtgtggggtgggtgcgtggggggtgggtgtgggggggggggggggggggggggagggggtgtgcttttgagtttttgagttcaaaattaatatatgaaaatgaaatggcagtcatcaaagatcaaacagttaagtcattatacctcctctggtgtcataggccccaaaccttgaatgcagtgtgttaaatacccattacttcactcaacaaccatgcaaataattaataaaactccaccatattgtgcacacacaagaatatttgttgccagaagatgatagactccacatgttcttagtctcaccctacctacataacattttggtcccagaacctcttgtacatttattttttatattttcacttctaatttgtttctccaaaatggtagggtagttaggataaaaaaaaaaaaaaaaagagtacaagtatatatggtgtacagtgagtgtataatatatctcacttccatagttgcatgcacacaaaatccatataggaagctatttggttttggtgtgaaattaaggtggggtttgtggtccacacaggggtggaataagtgcacatatatactaattctggttacaggacgcccaccaagggcaccaccatctccagctatagcctttttggtgtgcgcgtgttgatttttgaacaccatggttgtgtcaaataattgtgtagttggaaaataaaataaaaagtagtaacataatatgttggtgttggatatactcaatgagaggtagtgtcaattgccaattaagattggccatgccaccgtcacttttctattatccatattttactttattaattaagctagacttctaaataataaatacatgttaataaaaaattattattttcctcgtaatattatcattgtcgtcctaaattctttcacaaagaccactaaaatctaataaataaatagaagagaattacaaaaataaacttatcgttattaattcatttaatttttgtttattaatattataagagatataagtcataaagtataattaatgttacattaaaaaattaaaataattttaaaataattttttcacaacaattattataagatgaaagaaataaatagtatcacatcatcacaatttattgtcctaattaatctcttttgtaacatgcatctatttaagtgtttcattgtactataagaaagaattaataaatttcattactagtcatacactgattaattgagttataataatttcaaatcacctaataatttcttgttaaacacataaaataatattgatgattgctttagcgacccatccacgcgctagctacggtaatagtaatagattccttatttgagcttccctgctactctattattacatttttcataatttttaataacataggttagactgcgtgctggctacataatttaagtaaaaaaacagtagagcaaaaaaatagtcaaactagttaaattaaaaattagttaaaattaatcaatattacgtaacactcggtgttaaaaaacctggttcaagtaatttaaaaataatattttttagtgttattttttaatttcttaacctttttagaaatatctttttaattattggtttatttaaaaaaatggcaatctttatgagatttacattagaaatatttgtatgaatgttagaaagtatttaaaaaaaaattgcagacatgcttcttaaactaaggatgaatgtgtaagaaaccatcataattttttaatttgtcacgcaaatcattcaacagtacgtcttgtgataattaatagactttttgttaaatgatttgtaaatgtgatcattaagagcacatgctgggtacggaatcttgaatagtcattacttttgaattttttatattaaaaatataaaatgaaaaatattttaagatttcatcaaccttttaatggtaaatagattttatcataggtttatttgatgtagattgtgaaactgacgctgatcgatgacttatatgtaatgatcatatgattaacagaattatgataaatagattaataatgacctattgttattgttttatccaagactcacgccaaaggattttttttatatataaaaaaaactcacacctaaaacatacttcatcctaattaatcattaggcatcttaatcaattagtaaaatatctggatagagatttggagagtgcaaatagatacatacattcttttaactgtgacgtatttggaatttttttttgataaatatgtacatatacgcccaacaaaatggtgcgtatacgtagaatacattttgacacaattaaaaggaaactaaaagaatttcttataacaaacgctccttggaaaataaaaattatggaagagaaaaagaaaatggaaaaagaagcattgcttaaggtcattccctccttggaagtctcaaggacatatatagtcctaatcatatcatttggagacttaaaggaactagtatttgtatgcttgtgcattgaaccgtataattatagtatttttaagaatttaatatttttaatcacaaaccatttgtatttatctagagtataaaagttttattcaaattgttaaatgaactttttttaaaatgctaattttgaaattgttttcaatttattactttattatttttttattaatattatatttgtctcatatatatatatatatatatatatatacacacacatatagagagagagctgagtgacagagacttttttgcatttccattctttcaagattttttttattaatatgttgacccagagttttataataatatgagaaaattaaaagaggagttaaaataatatatgtgaaagactaaaagaacgatgatagagtttaaccaaaaaattagaattaataattagttaatactatatgaatacgtcttttttttctcattttaatattaacaaacataataaaaaataattttcaatatactaaaagttaatttaatttttaagtgtatttgttttaaaaaattaaaaaataactccaaaaaatttaaaaaattaaaatgtgaaagtgggaatatgaaaagtttagaaacatatgcataaaataaacaaaatttaaatgaaacgattaaattaaaattattttaaacaatttaaaaaataaaaataaaaataaaaatgtcacataatttagtgaaaaaaaccttaatattgttgggtcaaaacgaaccctcaaatcaatatgtgaaaagttgggttattgtcaaatcctcaatcaaatctgtcctgttgggttattgtcaaaccctcaattagatgcggaagcgaaaaatcttaagatgagagagaacaacacagacaatttgtttaacgtgagaaaaccttcttcaatgtgaataaataaaaaatcacgggacactaatccataatcaaacttccactataacaatgatgaattacaaataatcaaatacaacaaatggtggttcactcagcctccccaacaatggtgataatcaaacttctctaaaaagaggtaaaaatcaaactctctagagtgttacagtcgaactttctatagagatctctcaaatgcaaagtacgaaggcttgctcaaatatacactcaagaatgtcacttgagactcaaatatgcaaagcacgaagacttgctcaaatatacaaagcacgaagacttgcacaaacgaaagctctttctcatatgctttcggactctctaaatcagagtgtactgcctccacccctaactaatgcatatatagtagtagattaggtttaggattttaaaacctcaatggatctgggtcaacattgaaagagtaaagctcaatccaacaaatattacatatgatatagacagatatagctttgatctttttgttcgttgatattaggaaacttgatgctattaacttctaggcatattttgccaactatttagcaatgctgatataagtggctgccaaacgttaaatcttaagtcccgcactggatttttgttggagctcttaaattcatttttaatttaattttttaaagtgtttttaactcaattttttttaaaaaaatactttaactttttgttgtcaattgtaaaaataaatcattttgtcttataaatagtaatataaaacctatccggccgtcatcatgtctcaacacagtgaaatgtgaactcacttttttttcacttcaccctctttcctttattttatctcaagtaggtttgcatggtttatcaaagcatgatttacatgtggaactgttctaatttctttcaaaagacccaatataattgttactatggcacatttctttcatataattatcaacagtatcactatcattatcattaattatcatcacgatcatttccttcatcatcattgatcactatcctgtcctctttactgattttattcaacaaatgtgcaattaggaaattaaaagaatgatttgacaattaagtttagctagataacttggcaataagtcaagttttatcaaaccccaattatatattttatctgaacaggactaaattagaagcttgaatccctactagagttaatttttcatagctagaaaatagtaattattttgtgtcaacagcagatttgattattatagaaatgcacatggctagtggcagactcttattattactcataggtgggtacagtgctaatgaggggctccctgtgccatcgatcctaaggtgcacgagagtggtaaagcccatggcaaacaaccagcatgcatgtgccaactgcactgtgtggataaaatgccagaaaagtaatttaattttcaatgtatcgtaaattgatggaatttgttgatccgaagaaattaaatctatatttatctttgaatgaaagggattgaggtttttaaaggtgttagatttgtgagagacgataattaataatacagttgaaagaaaaagaagttcttgaggcaggagtattctaaataggagacatgtgaactaattaaaaggatgtgtgagaagattttttttttttttttgagagagagagagtattaccacttcttgtgattcttgaatgggaaactcaagcttctagagtgatactatttgagaagagttttttaagtttatgtaaaaaatttataattttatgtgagacaatgattttttttggaatttccatggaaataggcaagaagtgtgaagccaccttaaaactcactatttctatttgtgttatgtttttttgtgtcttccaatctttgatttgtgttgagtgtcgagagtttttccattgatgagattgggtgagctaattaattaagttacaaaagcacaatgaagttgatggtagatccacgtaaagatatccctgtatcggatatcttcttgataatgtgaaagtcaagtgattttagtgatgttttctgttagtggtaactaacaatggttacaagtacaaatagtgttaatactcataaatgaataataaaatcaaaactatggcagggagtataataagatttgtgcagtggaagcacgatgcgcaggacatgagagctagtgatgagatttggaaatttaattgaggaagagatttttggaaaaatcaatttaaatttctaacgaattggaagttgatggaatttcttttttgactcgtggaaagtcaacattttatctttgaaagaacgaggatgagattttcaaaggtgttaaaaatttgagacaataattagagcttgaaactataaaagagattattttgaagacaattgtcaccactcccaaattgaaaaaaacagtaatgtgagaggagacttctaaataggagaggatttttggagaagtggggggtggtttgggaacagagaaataaggttgtgtttcacaatgagaggcgggatgaagaagttaatagaacttagatatttgtcttttttaaattctatcattaacgtaattattaatatatataactcagtgattgaaatatatgtatagaaaccaatttcttagtggttaaaaagttaggagctaagttcaaatttttaacaactaaaattatgagacgttaagtaattaactaatataaaagtaaatttttattgaaaaactgctttttatatatttcaatcacattaataatataagagagaaaggatgctacattaaatatagtaataatcacattaataataaaattaataataagacaaatatcttaaagataaaattgtttaatctcatttttattttgagtcaattagacaaactcttattagattagataaacaaaccacatctattatctgtataaattaagaggtaattcggtcattgaaattgtgggatgttgtgatagtaattcttgatttttttattataaaagaaacagtaaatatctgaaattgaattatatcagtaaagttagtctcttttgttagtcatttgttatccaaagagagtcacacacactagcctatagagtttcggaatgaaaaaaaaaagtgtaaattataattgcatctcctatattttttttctaaattatacttgatattttttcttttttcatcctaaaaaaattctcttaattgtttaactcacattacactcagattccctttctcttaaacaccgtttaataattcaacagaaaataagtacatactgatcacatgacttttaataaaaatttatgtctaaaatatcatcatctccatcctcaaaatcatatcttggattttacaaactcttatcttcttcaacaactccttttcacttacccccctctttctcctcctccttcatctcccacaacagcaacccctcttcagatgtatccactctccctagaacaaccaccacctccactgtaaccatcgccaccattgtagtagccgtcatcactgtcatatccacctttaccacctcctcgtccaccatcgtaacttcaaccacattaccggtgcgtctggttccctggacactgacaccatcggagtcagtgacatcaataatcttgacatgttcgtcagagttagattcaatggaagaatattgaatgcaatttagaaaaaaaaaacacaggagatgctaatgtaattttctctaataaaaaatttcgtctattcaaatatttcaatcgacgttgactaacgatattaatagaatgatgtaaaagtaatgtataaaaaaaaggaatattaaatgtaatttgaaaaaaaaacacatcaaacgaatgtaatttaatataaaaaaaaaacacaccctactatcaaatttgaaattgtcacaaaataaatgggctataaaactaagttgggtaccaccgacacatattcattgtagtataaattttatttttggtaattattcattccataattttatgtctacaatctccacgcacacaaacccgtgcacacagactgcaatagaattaagttgcgcattactggcacgtactgtcaactttacttctctctctatcatcaacgttactcaatagccattttgttgttgttgttgttgttgttgttgtagggtacaaagtgtcaaaaactgcaatggatataagtttttcttataacagtaggagtttgaatttagataaatttaatcgttaccttccatctaaaaaattaatctcataactaaaagcatatttacttcttcatattttgaagaaaaacaagtataattattttctaagatttaatcatttacgaatatattataaatctatggaaatacctattaaagacaaaagaaaaaaatcatatagaataataacattagaattattttcgttctgcaaaatatgaagaagtaatagggatgtggtgattgtccaaaatctatcaagaccatctcatttatcaaagggatcttattcgattggtagaaaagaataaactgttataaaaaaatttaatacgtgtctttaattcttatatagatggaaaaaaataaaaaatatttcatttgttatacagcatgtcaaactgaaactttttctccaagcatactgatcttatctccaagcaatactgcaatagggatgtgcacaattcttgcttcccaagtaattagataatcttttttagtgctctcgggtctgcttatagagttatagtcaacatttctgtttgaaagtagagcaatactactatacaataaaataagcacatattttattatacaaagcaatttacacggtattacttttgcagatgatctttctgaattacaacatatataccaatcaaggttattgttttgatacgtgtactaagatatattttagagaaaggttaggctagtaacacattataggttaaaattcatggaaaattgcaaaaatttctaggttttgtttaagtttttttttttcttcttaaaaatcttataacatttctaatgtatctatgtctaaattattttttacttaaaataagttttttttataaaaaaaaaaggaagtaaatcttatttgctttttaaactcttattcctaattttgtaatttttaataattttaagtaatatgtatttagacattaaaaaagtaacatgtgttagaaagcatgttactgacatttttgtataataaatatatttttttatttgtagaaatctaaatatcataaaatttatcatatttagacacattattcaactaaatgaattgaacccccttaagaataaacaataaacatatttaaattgattatgtgtaaaaattcaatcataaatatcactaacttattattaatcaatttaaaagtgatataaaatatttttaattgatttaaaatatataaaattttatgctgaatgcatgcttattattatttttaggataagttgacaattattaaactgtttaatctattaaaaagtgaaaaaaatttaaaaagttttataatagagttttttaatctattaacttattaaaagttaggtcacaaaaaaaaaacttattaaaactcactataaaatttaaaataattattaaaaagttaataattttaaattgaaccagatttgtttttagttaaataaaatgataaaataaaaatacacttccatggaagagaacactaatgacatgttgaaactatcaacaaaagatacacccaaaagattattgcacagacctaaatcacaaattaggagattccaactcatccataaaaaataaaacatttcaaatctttaatcatttgtgtcaatcattgtttataattaaacaataatttatctttaacttaattgtttgactaatgtatttttgattattatggataaaacaaatatatgaaaaaatttaattagaaaaatatttgttgttataacttgaaagagaaagaaaagatcataaataagtgatatatttaattgatgtaatgtgatagaaaaaagaaagataaaaataaaagaaaattattgattgaatgtttgaaatttcttattgggaaaatataactactcttgtaattaatgacagttttcaactaaattcaataaagtagatagcttgggagccatataaatacgtaatgaaacggtgggaagaaagtacaaagtacaaaagtaacagagtaatctggaagatgagttttctcgcgggaaggttagctgggaaagaagctgcgtactttttccaggaatccaaacaagccgtgggaaaattagcccaaaaaaaccctcttcctaagaccaacaagaaccttaactttcacgaaggatatgatcatgcggatgtacttcccgaggttctgaggcactctcttccttccaaagtgttcagaaatgatgaagccacctctttttccttctctgcctccaaatgggtccttcattccgatcccaaaacccaatcttccgtatcccctgatgctctcaatcctctgcgtgcttacctttccctgccccaagtctcctttggccccaaaaggttccttcatcactcttcaatttcaattccccagttcttttcactttatgaatcaaatttcatttgcataatgttttcccatttgaatttcaactttttgtttttaaattgagtttaatttttgtgtgttattagtatactctcaattaatcagaaatcatcgttgggcgtgacttttaagattataattatggtaaaaattaacgaactaatcaaataaggtggcctgtcattggatgatattgtagaaatcctttacactgttagtgtatgctatttactctgttaaattttataatttgagatttaatagggcaatgaagctgattgtgattcatcttcttttctaatgtttataatgggtagttttgtttgttcaattgtttatgcacaatggtttggttacacaggtggcaactgcctgaagcagcaaacacggtttcagcctcaacagctaatgaatcgcgtcaagacagatatagcacccatgttaacccggagaagttgaaagctgcaggtgaagggcttgcatatggtacattttcttctcattaacttcctctaactgtagatggatggtatctctaatgcaaattctcactgatgaatatgtacattgttgactctatctacttgacaaacttacatatattaggtttggtacttcatctttcacataacctcatcctgtctctgtggactttatagtggaatctgttgcagataatggtttaaggaaaactggggtgtagacaaggcccaccataatttatggtcatcctgtgatccctctatagaatgtgatactctgttcatctttgaccaaatatgtcaaagttgaaataccaatatattcagcatcaggtgtggctactaagaaacttggtccaaccagtttgagttgatgcggtagtataaaggggaaaggttttgggggagattaggtaatcttattttattgggtgtagagtgtggattaattaatttgagggagggaacttgtgacactttcaagtttctcatcaactaaacgagctagagttaaaccttcacagggtccctgtaacagtagaaaacttgtagttgtgtgatattaaattagcaatattggtaagtttaagtgagcaatcctcaagtatagagctttaagctgtttaagcaatgttttgttatttgttgggagtgttacaataagacagaccttttagtttgagattgaggttagagtgttttatattttgaatatagaaattgaggaggagggagagggagttaagtcatacaatatatgttgcttttatggggaatgaagtaatgggatactatttgggcagaagttacttttctggtgtaaaaaggtttagggttgagtgtgtggtaatagggttaataaataaaaccaaaataggcatcattttctctgtttttggactaagtatgatttagaatatgaaaaactaaagtggggcattagcagttataatcagcaccctgagaaacctgctttggattatgaactcaaggagaaacatatgggggtcatagttatttatagcacacaatatcacttgctatagtcctgttgctatcaccagaagttgcactgttgatacatgtaaggttttgtgctttagtttgtaaataccatgtctatgaagacaatgcattaatgtcctaccattttgggatagtgaagcccgggaataacctcacttttttatacttgatttgcttgtacataaagttcagttggttgtttagttcattagatatgactttattttatttttttatgctcattataccaataatgaagttaagaaaaaaaaataggtttttggcaaattctttgtttatgatgcttatgtttgctaatgcaacttttaatttccaattttatagttggaaaggcgtttgctgttgccactgcatttgtatttggtggtgttgcattggtatttggtgtggtggcctccaagttagagctgcagaatgtaagtgatttcaattatatgcaatttttctctccctttcttaatacatgtgtatgcttttaaattagtcaagtaacccacttgaatgcctaacttgctgcatttttattcaccattcttcataaattattcatcatgttgaatgacatatttagaaccataaaacttcctcgtataagcctttggtattgtatattgatactgttttttcttctatggtttttcagttttattaatagatctctatattgccaaataaattgtccattttagttttttaacttctttatcggaaatttttgttgtttgtaacagatgagtgacatcaaaactaagggaaaagactatgttgagccacaacttgagaatatcaaagagcaatttgttcccttaaagatatgggcaagttttaaactgtatttcttttatcttttgaatatttcaattcataagcctaactcaaaacttggatttgcaggctgagaatatgtcaagaaagtggcatatggaaagggatgatgttaagcagaagactatcataaaggagctgtcaaaaatttggggtgcaaaaagaacagattgagatctacaattttatttgttttccttttactttagttgctttggaaatagtggcatggacatccaaacataggtaatttggatgaagtatgtctctggcgattcttatggccgtatatgttgaagcatgcaggagagtaaaaataatgcaaaatagtgtgtatgtcaataattcagatagtaataaattgcggaatatggttgttttggttaattcaacaattctttttttgtttcttcaagcagactagacatattgttaaggttctgaaaaccatgatctgttgtaacaagatgacttttggcaacgtgagatcaatatctaacatggttggtagtaaaatttaatagaatcaattttgcattcaaaattatgactttagccacatgatggaaataactcgcttaagacaatatcaattactattgttcttttaattatatccttacttttatttaaatatttatacactacatataaatgaaagcatagttaagattaatttaggaagctaaaaataattttgatataaattaatagatttagataaaacaaacagaggaagcattgcttcttgaagatgttataaggatgagatgactaagagttagtttgtttaaattaaaaaaaaaatgaacaaaatacttttttagaaattgttattttagaaatagattgaatttacttcttgaaaaaaaaaattacctttttaagtaaaaatgatttaaacaaactaaaaaaaatgcttattttatttaaaaaacattattttaacaaataagtttaaaatggaccctatatcaaagaaagttctgaattcactaaacatattaatgataattaagtaattgtcgttataatccaccatttaagtgccgtaaggaatgctgtatgctgctattgatgttgtttatcgtggaaaaacgtagacacaccatctcgttatacataaagttattgtttataatcacttttcatagaaagttgtaaaactcaaatttttatagactaatgcctgtttatttattaaattgatggtgttaacatactgctcactaaggattttgatgaaacgtattataaacatctcattttattggggacggaaaacacattgttgaaatgataagctagaaagtatagatatgacgtttcttgcaagcctaatatattagtgatttgatttggtgctctctttacatgctacgttttggaacaccgtaccctatggacaatttagatgatatatctcggacttaaaactacttttcatttatgtcacctcacttgatgttgaagtggtaaaaatgaatcaaaacttcacgtttcaattgaagatcaagaacgaatgagatgaagagtaaatcttgagaagaaccacaagaaattggatgtgagggaaaaaccaattatgccaccacatcatctctattttgtaggtttatttgaatcatatgtaaaagtagttactataacttgtaatcaagaccagctccatatttccaagcctcgagatgccgcttccactggaaactcgtcttggatggtaatgtatttaaaaatggccttgcaatacatagaacatgcgcatagaatataagggtgtgttagttggacctatatgcttgttgaataagtaaagaagctaataagtggtttagaaggactttgtaaagacttttacctcacaataggatcagcaaaggtcgataaaaaggtgtagtagccaagccccagaaaatgtctggaccaatcaagaagtacaggaataccaacctggaaaaagataaaatgctaaatcctctatattgaaaaggttgtttcactaattatttatgctgtatatttttattgacctccaactagttgttagatgtttgtttgtccaattaaatgacataagaaactaagagatgaacatataaattatgttacgagctatgtctgtcaaagccgcacaaacatgttggaagagattttttttcagtttttaggtatttattcatctttacacagtcttgaaatgaaaaaaggaaataagttactgatagctaaactcatgaatacctgtttgaatatggatgggagtattttaggatttgttaacataaccaggcccaatgtcttggaaagtggaccaaactgtacaacatcctgcaataaaaaatggataattcctcaggacagtcattgttccaggtttgaaatttgatattggtttggttctcatctcaattaaatgaatattttgggaagaacatctcacaaatacaaagcaaaaaacatatccagagtttcagacagggacaagaagtccacctgtagaaatggtcggagcactggatcaccaagcctctgcagaagtgatagataaaatagaagtaacagtaagtaagaaagaataaaattataatctgagtcatgagagaaataaactacctgcatacaactaaaattggtataaagaagttcattaataaaatctgcgggaacattggactgtttctttgctgacattgctctttggaacaaccatgaagcactcaagttgggctgcattatacacaatattggccaggtatttagtttcatctacagttgctgaaacagtctttagagaagttggaaagtaccatgtaaggattcagcagtgacaagctgtatgagtcaagataatcaccattgattgcttcatgtattccttcattgtaataaagtgaaaaaaaggaagggaaaaaaaaaagaatcagattatctcaacaatgtgcctattttttgttgatagctgttacttgtttgaacaacttcctaaatctgtttcagccacattatattttactgaactaggttgttccaatgtagctgaaaacagaagacaaggtaaagaaaaatggaggtggggagttcactcaatactcagaaaaactaacagattcatagtttcatgtctcacagataaaacataaataaaactatgaaactaaaaataaaaaaacctcctgttccacaacattgcaatagatctgcttcaactagttcaaaagtatacattagaagtttgaaatttcaccgaaaggcttaccagctgacagtctccccaggtgcctggtcaagcttccaaatccaccaaatgaaacaggtgattgtatgccactagcatcaccaaactacagagaatgaagcttcattactttaatattagttgatagatcatagatggcttaattttatagaggcttcataagtgtaaaacgtaatttacctgtaaaactctactaaaagcagctggtagcggactgctaggtgctccatttcatcaaacattgtacagttattaaacaaacgataggtaaagataaaagtaagaggaaacaaaataactttaaaacgaacttgggaaatagcagatgttaggtagagacagaggacacataaagttgaaagataattttctgatgtgcaattaaatgttggacggttcacttatttccactcaatggagtagtgccatctggcagtgacaggttagccaaagaaacatttgaaaatttcgaagtgagacattatgaaacaggcatgaggaagttccacttatttagtagcttccacagtgagttgccatgcacaacacatggttcaaatctttaaatgaattatgtgttttaacttatagtattcaaatctttaaggtcaaactactggctgactggctgtattgctttcaggtgtcaatcttaagtgaagcaagaactttcagtcagagaaaacaaattgtgtgtgtgtgtgtgataagacagtaatggggagcctattgtagaacttatcaactgatttgtacatacatcttctaatacaaattaatacctctcgcgatatgtgggaaagattccataaataactctcagtatctccaaattgtcaagtgaaacaccctaaacgaagttgcaaattgacatcagtcaagctgagagcagtagaacatcagtatagaagaatgcatcaggtcaaatatagacgttttggttacttatatgatttcaaaaagtaatatttgaagagtgtaaaactttatcagttagcataatcatgacagaactgattgcatagatactctttaaataaacagagataaaagacaaggataatatgatgtacataactggaattgattagtaacataacaccaaggtaatcacaaacagttttgtgacttgataattcatacacagactggcattttcaagcttctagtttggctgttaagaacaggacattgaataaaaagatctttttacttcaaatcttagtttttccatagaaaaagaatttttattagagaaaagaaaggaagcacagacaaggggaggataaatatgtcctccaaaatgaaaaaaataaaaataataaaaagtcgagccatcagagaacacaatgaagaaaataaaactagcctgatattctggcatcaaatcccagtacgcttctaataattcttccaattttggggatccaggttgaggttccacataagtgaacatataagtagtacggtccaaaggacctgagcctgctggaaatgcctgtgaagatttcagttgaagttcttaaaaatagagatggggatctgtgtttctattgacatagtaagagttacctcccaaaataattgtgcttttgaatctccaactttctttattgatgaactgctgaatatgacatcactagtggaatttgtttcaaagccacgtgcacatgttccaacaacaaggcaaacaccatcaggcttcctcccacctcttatctgtaaaatcattgaacatgacacttggaagaagcttcaggaaaaggttttaatttttatattcagtaggtacttatctatctttcattaaatcaagttagcatatgtagaactttaatgaatagaaactttctttatattctcaatggagtaatcagtctcattctggttggtgatgattcaatcaataatactggatgaaagataccattattttcctatcctcccagtctcataatcatttaggaatttagttggctaattacttatttaacagatattgcatcacttgcatttgcatgcatattaaatgatcttgcacgtacatatattagtcaatgtgtcctacatatgcaggatagaacacacaacagaagacctttatgttgtctcactcgaagacaatcacccttacaaagataaacaaaggagaacatataaatgacagccagagcctgtataacgtgataacatgatgaaaggagaaaacatcctagtgatcacatgatgaaaatcatgaactgtctgtaagaatacaacaatgaatgaaaatatattcctgacctgttttacgacaggggagaagtttcccatggcatcaattataagacgtgatgacaatattttgtccccagaaagtttcagaacctggaaaaaaatacatgcattcatgcttctttatcatcaaataaaataaacttatcattcttcagtcccatagttaaatggtactttaaaatttccatttcaatgctaggttcatgtatgatatgtttgcatgcttcactgtcgcacttcaatctactgtgcaactttttttctggtacagtaactttctttatataaccctttgatgcttacctctagttaggtggtgtttgtaaatgcgaatatatatgcagaaattcaacatataaaattctgtatcggctgcatggcctttaataaactaacacttgtgatggttttttcaccaagtaagggccttttttatttttaattaccaagtgggggtaggttttaaaaaaattaccgtttaggggtaaatcgtaccatgtggcatgactttttttttaattatttttaaaaaaattgcactcagaagtcgtgaaagtgggtacgactttaaagtcgtaaccacatttaccaattctaggctacgtttcatttttatttttgtatttttgtttgcgaccacaacattcagtcgcaaaaatttttagttactgaaatagcgaccgaaattagcacgttgcataataaaaaaaactaaaaaactaaaaacaaaaatgaaacatagcttagaagttgtaaatgtgatgacgactttaaagtcgtaaccacttttacgacttctgagtgcaatttttttaaaaaaaaaaaaaaaaatcatgtcacgtgacatgacttataagtttgaagcccccgcttgatgaaaaaggcctgcactagaataactagttctaaaagttaaggtaaactcactgcaacatcctcatatacattaatgcaggagacgccacacccctcaaaaatgactccacctagggagataaaccgtgactttacaatctctataagctttgcaggtctgcaattgcaaatagcaaaaatgagtatgattttcaacagaataatgaattttatactcaaattacataattgtaaactccgcgcctatagtaaaaataaaatgcatgtttctgagagccaagtccagataatattcaaaattgtgtgcaatagtactaatggaagcgcattcatcataataattcaagtttttttttcatctgcttgccatttcttagtaattctatatccagtttgctacagcagatttcctgtcctctcttgaaggaattacacaaaatacaacaattaagtacgtgatcaaattagctcattttgtatttaaaatagatttagattataatcgaagtcttaattagaaagattttgaataaagaagtgatttttctccaaaaaaataaataattcaaacatgcactaaattaaagcaactgtgaccgcatattgttcattgccaagccagacaaaaaataaaagaaaaatattaactagataagaacaaagattaaattattcattcataattgaaatagaagaaaacaattattatatttctttacaggtatatcgaattagtttatgggaaggagactcacaaaacaccgagattaagtatgtcgttgacccatatatcccctttcctttcaaatccacatctgttctgcatagttcatgaaattgccaaagtgaagttagtgaaaaataaattaaagggaagagtaggagccataaatcctagagaggttacaagagaagacatggcttgaaggaaacatttgagacatagatatgccatttgtgatacagcttttttgcctataggagaaacaaactattggtgattgaatgttctttgaggaacaaaaaacaatcaagcagtttggaaattacattgaagcactgaacttaatacttcttaatatgtaagcaatggtcatgttgtgagaactcaaaacttacatgaaaaatcagaaattcttaatttttaagcacaatgaaaaaaaaatgaatgaattgaaataggatgaaaataattcaatgattcaatcttaagtatgtaattgtaatataaaaatcgcattctttaattacttcaaagacacacatgtataacacaagaaagtatcgtgaattaatattcatggaggatattaataataaaacattaatctaaccgtaacaaaagtcagagtaagactgccagggtacacgtatttcatttttctctaccttgtaagcttgaatgagtttctcttttataagtttttatacaaaattaaacactgttgggtcttttctcttgggattgacaactaaatttactgttactaagtagaaaacatgctaattttttgtactgtttgataatatcccttggttgttagataacttcatcttgcagtgctctatgaattttgtcatttctttgtaacaaacaagacctcattgtttagggatgtgaatgatgtgatgtatgttcaaagtgacttgaagacagttatggagaaatacctattcttgctacatattgattggaaactaaactgaagaagttcaggaattacaggattgaattttactgctgtggctctttcaatgtcatcttcttccaggactccaacttctactagttccgaaagctccttagttgatatattccattcttgctctctctaatgatcaaaataacacagacaactcaaaattgatccgacccttcaaagaatttatcgactcttttctgagtaggattgaatgctgatatctcagtcaatgaaactgaaattaccccttttagcacatttctttccacaatggcaactcgaagacccctagcacacaaggccgtggcaatgaagatccccagagtgcctccacacactaacacatcgtatgatccctctgctttgtcagcaagatcagatgagccaaacaagcctgggatggtagagacaacttgctgaggctcttgcacaactgcaatgcatacataagaagattacaaaaatataaaatagtctcatttcctaaagggtataagaatcattgaatgacatgaaccttcttgagaggagcatatgcttgaccatagctggtctaatcttttcaaggcttcatatgagtatgctccaccagcaccaccaacttctccactcactgaaacactctccattatcatctataaaagtaaaagaaatgagtttaattttggtacacttttagtggaaaaatatttttgtgtcaacaaactagaaaacaccttaaatatgactaattattacaaaagtcaataattttatcatagatggtgatccatgattgaatgttagtgtagaaaccttaacactatcatgcattacaattaaattaaaaataaaatgtcatcatctttatttggacttgttacatagaaaacacaacgtggcatgacacagtgaagaattggtacctgggttctggagggaacagcttgtgatctcaaaaggaggggtcttcggctaaatttcttgtgtgggaatgaagtccccaccgagagctgagatattccattaatgggttgaagccgaagaattaacataacaaatgaagctcaaaaatttagataaacaagagagtaatcgaagtaaagcaagcaactgtttttttctcgattctctgtttgatttatcaattatcattatcagatttgaaaagggcaacaaatttgcgcaccacaagtggacacgttcaaccaccaaaactgtctgtgtcctttccttccctatatttctcttctatttttcacttaattagattagatatgtctaagttactcccctagatatctttgttagatatgatatgagaagtaatattaaattattaatgggatatcgtgaaaataaataaataatctatataaacttttttagattaattagaattttaattaattttaaaaacaataatatttttattttatttttaatataaaacttattaattttcaatattttgtttgttttatgaaaatttatttacttattaagaaattaaaataaaaaagagagaatttttcattttcctccttccatttcaatgtgggagaaggtttttttttttatttcacaacaaaaaaaaatacatttatatttcctcttttgaacaaataataataaaaatttggtatttctattttattttattttcttatttgcttgcttcctatttcatatgttttacatgatcacatttgaaaaaaatatattaataatatgagttttaatactttttgttaacatattttcatgaaatatttgtaggtcgtattaaatgcatatagttgtgtgggcaacagagtggcactccactgttactacttaataaaggtttcaactttgaggataaacctcaccggttcttacagggtttatcgtttaacggttgaaacgaagcgaaacctccaactgcatcttcaaccctgcgcttcttttcaaccgataaaaacttcgatcatttttttttctgctctttagtcggtgttcatttcaattcagaagtcaaaacatcggagctcatcaagtatgttaatcactttcctcgcattcacgaattgggtcttgaccaaaccctaattagaaaactagtgtttttacatttgtaattgattggtgtgctttggaaactgaagattttttttatgtgcattaagtgtatgatatctcctctgagtgaatgacaatgaggacttaaaacaaccggaagtgaacattgatgattttctgaacttcaattgttattcatttttctggtccatttccattccattgttgtgggtttcaaagtgtgtaggtactaggtaaggtaagcctcacccttcaaaatttcaagaaaaataaagtaggaaacttgtttccttttctagccatatctgatggaaacagacacagcacaacacacaaataaaacaaacaaacccacatagggaagcataactacacgtgctactatggaatcaacggaaggctatgttatagtgtcagtttttccccctttgcagttaaaaattaactgagattactcatggtaatttaagagagaaatgtgttggttggttcctgttggaacttttattcaatgctcatcattaaaattggaagtctttgaatttcttgaaacctttcttgcagatttgtgctagtttgcaagtgaagctcatttattgtaaactgttaacaggcatggcaagcttgttgacaacattagccattacctattctcctgtcaacaatggttccaggggtttcagaaagtcagttaatgcttctaaaggaaggtgctgcataaaagcaatgaggatagagaaatccttggaggaattgtacaatgtgaaggtggaaagaaaagttcctcctgagagactagccgagcttggagtttcaaaatggtcagtgtggaagactgggaaaagcaggttgccttgggactggcaggtagaccaactggtgtacatagaagaaggggaagtgagagttgtgcctgaaggaagcgagcgtttcatgcaatttgtggccggagacttggtccagtacccaaagtggcttgaagctgacctctggttcaatggttcatatcaagaacgttatagttttcgagcatatggtgatgatcattgatgagaagatgatgcttggtaaccatttaaaagtaacatgcacatcttatttggatgttttatgcaatagatgttttttaaagttctagttttccagttctaaatgtattaccaatatttttgaatgtttgtgatactttgccatcatttaaaagaaatagtcctaaatgcttctgttgtatccttttcatgttctgcctctgcaaggcaagacttcccgataagttcatatcgaccaacttcatatttttgtcttccaagtaggatgtaaaatcacaaatgtccataatccaaagtggaacatttaactctgcagtaagtgcatcatagtgttacgcacacagattcaatttgttttttacagccttctataaaaatattaaaaaaaatgcagactagtacaagaaacgtctcgttataaacgtaagagcacaagaaatatctcgttataaacatcagagcaaacgtattcatttggaaaggaggcatagatcccaaagaacccaacccacaaaggttaagtaataaataagaaaaggtccaatgaaaagcacaaactccgaacgtgtaatgacccccctctagaaagaaaaaaaaattggatccactgtgacaagcagttcagccagcgaagaacaaataactgccagagggaacaatgggttcagatctttttctgcaaaaggctaaaagaaatagaaattttactaatgttaaaattacataaatatggcaaaagaaaaggattgtttttgtatcactgcataatctcaatggctagacttctaaataaacactgcctattataaactacattccttatgatacatagtacaacccatgattccagaacagatgatggagacgaaaaagcccagaaacaaggagcagcctgatatccacatcaaccccattcacctttgttcctcatcatgtggtcagaacaaacaatttggatctctgatggctctcaaccacctgcagttgccaattgattcgcactggtagcaattgcaacagaggacacaaaccttgagacaaggatggcctcattgcttactgaattagctgcagcaacatcttccagttgtttccatatggattctcgctttttttgcttctccctattcttgatttcttcttcttggaatctcttcaagcattcatcaaaaagtgcctggtcagcatcagagaatatttttctaacattcatggtcaagctctgaacagcttgattccaatggtcccgtatatttttctccatagcaggaaagattataggcagtatcactttgctgttttgtaagatcaaatttcgaatatgatcattgttccacagaaacagtgctcgttcagctacctgccaacaaaatcaagtcaacatcaaatctaattctttgagactgattccagataataaaactaaagtatgttgtattgtagaactgcagcttgtaacacagaacacaaatctacaaaatctttagttgtacaaatacaagttctaacataaaagacaaccatattaaatattttgttgttcaactttcaagcaaaatccaataatcatttcatatgaaattatgaataaatatcaaatttctgagatttaacataaaagaaaaccatatatagtatatcgttggcaacataagtccaactttcaagcaaaattgaataatcaatgaaattatgaattgacataaaatttgtgagatttaaactattatttcataaggcataaataagatatccaaataataatgaaaggaagaaggaatgtcgagtcacaacatctttatgaaaaaagttcagcagtgccacatctgaacccaactccaaaaaaagaaaaaaaaaaaaaaagagtaaaaacactaactaccactgaagtttcatgatattagacaaacaccccttcctctttctactcctacactaatctcccttagttatttaaaaatatacattgcatccccttatacattacattaacccccttaagttatttaaaagtataaactggaacccccttaattgtttgaaaaatatcacatcaggctctcctaaagggaaattactgtaaatgttaaaaaaacgggagatttgtgtaattatacaaaacctcaggtggattatgaaatttactcaaaagaaaaagaaatggcaatgaaaaaaaggcaatgctaatgtaacatagtttggctttctagtatcaatacaagtgcgctgatctgatggttgagctccttacatttgttaaattgattgcggtttcgacaagtaatcatcacatattagagaaatagaatgatagcatctaagatagctaagacaagcaaagtgggaatggaaatgaaatagaaatagagatagagagcggtggtcacaggtgttagtaaataatgctaataaaatgaatgcagacagaatatatcacaaatgaaaaaataaatatgggggaattttgtaagcacctgaaagtgtaagctattaaggcatctaccaatttgacgaaatagtgggatcacacatcgctgaaattctgctgcttgagttgcctctaaaacttcctccaactcactaaggaacattacctcctttgcactattagttatcggccaatatttcaaaaggcctcttaccacagtatcagctagtttgacgtccttctcaacaaactgagtaatgcaataagaaagctgttgatgataaagtgcaacacacttaggcttgtgaagcgggatcaatgcacgggccagaaacagcttatgctcttccttcaaaggcaaagcaaaaccattaattatgctgcccaatatttcaagcaactctgcaatcccactgtgtttctctgtctcaaatatgaacctgtaaaagatattgttgatagcttttctaatgaatggccgatgcaccatgaacttcccataaatgcggtggaggatagtcttcaggtaatccctctctctttggtcttccgagtcaaaaaggtcaagcagcctcaacacaaacgaatgatcaatgtatcttttagcaagcttagcatccgtctcagttgaagccacaaatctaaagagaaattcatagacaatctgcagatgaggccacgctggttccaaaacagtttcctcttcgtcaggctcacccatgtctgccaaccttccatcatgattggaagaaggcagagcgcgaaataaattggttgccaccatcttggtcatctcctgcatcgcaaactcgttgaacttcgaattcacagacgaaacataatcaacaagctcaagtagagtttgccgcttcacgtccttctctttgagatgcttggcaggatcgttgaaatcaaacacaacacagcacaaattcaactttctaataaaaagattctgcttctccgagctaggaacatccctgaaactaggcaaagcctcataagctgcagaagccattactgaacctgtagtaggagctaatttcttagattggtttgaatggtgttgagcaatagtctcattcccagaacgagacccaactgaaccagaacttgaagattttgaagaaactgaattggatttcaagagggtattagaagatgagttcagtgagaaaccatcattgaaccctccttccccgtttgaattattgtgagatgattttgagggtttgcgaggtattttaccgaatatctgtttaatcatatctagaaaaaacccaaccccaactatctacaaaagaatcaaactttcacaacctcgatcaataacattatcgaaaacaagtaacgaaacacgtgggagggtgcgatttaagcacacccaaataccctaatccaaaacccataccacgaaaaacatcagtgaaatttgtactcataaattcacggattgtgggtgcatgagctagggcgtgaagaaattgacggaatgaagaagtggaaagaacttacattgagaataagagtgagaagatgctacgagagtggaagaaaatgcaagaaaaatagagagtgaagttaaaaagagagaatttggtcacaggaaattagccctagtgagagaaagctgatgatgtacgtggcccaattttgatatttgaattttattattttttattttttataagagaaaagtcagtcacacgttctcttgtatgctcttttaaatatatatttttattgtcctaaaaacatacatttttattattaattaaattgaaatttataattttttatgaatctcactttttatttaattattttttaattttattaaatttaatcaataataaaatatgctttttacagaataataatttaagtagtattttaatatgtgtattgtcttaaataaatatttatttctatacaattgaaatttatgataagttaatgttttatttacgtacataagttttatcaaattaaatgaattatatcgaagaattaatttcttactctctacccaatgggtttatctaaaaagttttatcaaattatataatattaaaaaataaaactttgttttgtttccaacagggagcagtcttatgaagatcctattgaagagtaaagtagttgtttcagtttgtgtttccacatttttgttcaaatagcttacttctatgtagtttgaccctaatgctagagctatttctttcagattgttgtatgcagtttttgtagtttcaaatgaaaatgtaacagttagggacttggcaacaaccctacaggctgatttgtcccagttgcaagctgctgctgcttttttgtgtcgattgggatgggcaacaaaagtacttgatccagaatctattattggagattcaactatagttactatacttgcatctcctgttgcaagtacaactagtgatgaagatgcttttgttgctagtcaaaattatgagaatactctttgctaatgactccattcaacaaggggatgcttcagcttcaggaaacaatggacctcgttcttcctacacttgtgttgctttcatagttgatgctaatattacatcctatcttatgatgggatctgtttcaccaggtttatacccttcactcttagccttttcaagcttaaattatttcctgtagttttatttttttaaatagttattattattcttaaaggcgacttggataaatttctctacaaatactaagaagaaaataaaattttgactactcatgacgacttgttacttaataatatttctgaaactttgatttttaaccctgctgaatgacgtcgtgtgatccatgtagtcgatctcaactagtgggataaggctttgttgttgtattatgacttcttgtgtgtctcaaaattggtttttgcgtttgactaaattatacttcttgccaaactttgcaggcctgaaatctcatgctgttacacactatgaagcagggaaattgggttatggcagcattgctgatctttgcaaggatcttagtaccttggagggtgcaacatatgagggagaattacaggaatttgctaaccattatttagtctacgttgtgtcttagagtgtctacaatcaggttgactatttaccagcataaaagaagagggaagttctgataagctgattacctcaagtaatgatgggccaagttctgagatagctgaaagttctttggttgataaatcaggagactgtagtgttttagaaactgtgataaataatgaggatctaataaattctgattcatagaagcttgtggaggcttctatatacaccgaccgtgttcctagtggaatagatgatgaaactcgttccattactttggaggatagcagtgatcacattcacgaagctgacaaggcacacacaaaatttgattgtaatgagaaactagcagtatttgaaagttcagatgttaagacaggaatgctaaaaaggaaaatgaaatatcgtgtagacgttcttcgctatgaaagtttggcttctcttgcaccagcaactcttgatcatttgtttcttcgcgactatggtatacttgtgtccatagtgcctcttcctcattcaacaattcttcctagacatcagtagttcattttggtcctcccacatattcttctgagtccttggatgaaattggttttatactcaactgcaggtagtggccctctatcagttgttctgatgaaaggacagtgcctgcgcttgcttcctgcgccattggcttgttgtgagaaatcccttatatggtcttgggatggttccacaataggagggttacaaaggaagcttgaaggaaatttagtgaagggaagtatcctcttgcagtgcttaaattcacttcttaaacattcagctgtgttggtgctgcctcttagtagatgtgatcttaatgaatatggaaaattgattactttggatatccctttgcccatgaagaatgccgatggatcaattccctctgtaggaaaagagttaggactaaatgaagaggaagattctaagttgaattctttattgaccaatttggccaacaaaatgaaattgtggactgttggttatattagactattgaaattatttaatggaacaaaatcagaccaattttattcaaaagagaaatatgaatgggtgccattgagtgaggaatttggaatgccattatttagtccaacgttgtgcattagtatatgtagaaggatagtttcatcagagttgcttcaatctggctcatttggtgaacactatgatgaaatgcaaaacttaaggaaaaaattgcatgatatttgtgatgggtaccaagcaacaggtcccattacaaagcttctttaccagaaagagcaagcttttggacaatttatggaccctgccaatggaagatggaattcactagtggatctttctcccatttctggcgcattaagtgtgcgccagagattaaaacttgttaatcgacaacattgccaaaatgaagttttgagctgtgatggcaattttcttagttttgttgctaaatttctatcaattctatgcttaaaggttcttaatttttgttagataaagttctattaccaatatcttggcaaacaataatcaaaaagatatttttctgtatgactcacaatcttgatttcctaatcatcccaagtctactattaaatggtgcatgcagatcatacacattacttcctgctcatgaagctgccacaaaaccaattaaagaatcccttgaagccgttacaaccaatacgataaaaactgaaccagaagaaaatgatagtaaagaagcaatccttcctggagttaatcttattttttatggttctaggttgcttccatttgatataggtgcttgtctccaagctcgccaacctatatccttgataatagatgcagctgctgcctcaacatatgcacattcaaatagtcatgaagtcattaatccttataggttattacacttcagatgcaattacactgtctaacttgagcttaggttgaaggtaaaggttcatttctttttggttgttgtttgtgtgttttaccttttcagtgcacttctatggattttgtaagcattactatttaaataatgcatgttgtttctgtttcagattttgctagatcaagagattcaacattattctagagctgtgaaaactgaaaagaggaaataccaaacaatccttaaacaatgtatatatgataggattttttttcttttgctcctgtcacatgtagtaagaaggacatgaagtcacctttggctcaaatttcagcaaaacatagccatgggaaattcttttacagtctcacataatatgaactaattgtcttttacttcagtggcttccttatggtccatgtgtaatatcgatctattgtcttatgtttgatcttgtaagccaattaagggataccatatatgattgtaaaatacaacatgtaactaataacgataaattaccggtgtcagacatgtggttggatgattagtcttctttagatgcaaagtctttcattcaattataatatatgaaaacatcatattttataatatcttaaattatttttttaattttagttttcagatttagtttttctgcagtaaaaaaattataatgtaaaaaggtgaggtcttcctttaatttaaatccaggagacatcttagataagtctcagcccatataattgaaaaagtcaaattatatggtcataattcacaaacattaccgaaaaacacaccaaaagtcatatagattgtcacaataattacttgtaataaatgagagcaaaaattgtgagaaaattaaaataaaaaaaaatgcttttcacgaattttttttttttaaacaattctattcagaatattgtccaacattaaatatagaaacatctctcaatgaaaatttgacccttaattaatcacgtagtgggaagactagtcctaaaaaacatttatttttataaaactaaattttataaaaataaatgttttaaacatataaattatattttaaatttatgataaaaaaagttatatgtgatacaatatttcttttaattattgctattttctttaaaaatttattgaaattcaatttattgaaattcaatttaaaaataaagatggaaatgatagattaaaacttaaaaaagataaataaataaatcaaatatcaaaataactcttagaaattattgttggaaggactattttattatcctcgggatgtgagtaattcttaggattaatatcatagtcattcaacatgttatccctcataaatcattcttaaaaaaaaatctcacttaagatatgggtaatatatttttattttgtataatttaaaaaaaaaaatagctgcgttaatgaagattgataatttgataagagatgatttgggttcccaaacagtccacgcaaggtacccgttgtggcctgtgggagtagaagaaataaagcgaaaactgaaaagtgtagaaaacggcgtcgtacgtatgattgcgtggcaagtgaggtagcgtgtgtgtgtattatatatatatacaacgtaggacattgtaaaagactctgaagtgtgaagtgtgaagtgtgaagtgtgcgtgagaaagaaacagagtgaagagaaaggaaaaaaagatggaaggagagaaagagaatcccgatggtaacgcagctttggtgaactccttctgtgaaatcacttcctcttccaaacaagaagcccttttctttttggagagccacaatttcgacctagacgccgccgtttcgactttcctcgacaacgccaacaaccctctcatccctcaaaacgacgacgtcgtcgtcgctgcaaacccaaaccccaactccgtttcccctccctccgattctcactccccggacttcaacccttcgaggtctccgtctccgaatcgcacgccctacgagctccgatcccgcaggtctatcggcaagaaaccctccaccagccgccaaggcaaaattcgcaccgtcggcgatctcaaacgctcctcccgcgatgatgattcagattccgatcccgatttcgaacccgacgagtactacaccggcggcgaaaagaggtatccatgtaaattgatcatattaattgttggaaagtcgccttaattgcaatcacccctggcccaccttagttgtggcggctagcctggtacatgaggtatgctagagatttcacatctgactagtgatatgaccaaaatagaatatacaagtgagagacaacctgttgagttaggtccaaatccatattctaagactacgattgtgagataataagatccgatgtggcttttttcgttgtaatgtgtttatatatttgatgctacatgcagtgggatgcttgttcgagatcctaccagaggaaacagcaacaacaacaatgtggatgatatctttgatcaagcgaggcaggttgctgttgatgcacctccggagaatcctcgaagctcgtcgaggtcgacaagttttagtggcacggcgaggttgctctctggagagagattgccatctgctgctgctgctcctcagcgtgtagaggaagttacccacactgtcactttttggaggaatgggttctctgtcaatgatggtcctctacggaggttggatgatccgcaaaacgcaccttttctggaggtagtttgccattacttttgcttccaaaagctcttgttcgtaggcttttatccatatcttatgtttatcttctgaggatgtatgtgcatttggggaaatagtttaattaagtatgtttattaaattaggatatgtttgcataaattttttctataagccgattcataggagaaggaaataaaaaaggaaaaataagaattttaaatttttgttatacataagtttttaagaagaggttggtgatagtgattttggctgcaacatcaaggtttcttgaagtgtatgtggccgcaattgtgaccgcatttgttgcaactttccacaatatcatgaaaattgatgaaaccacagccgcaatttaaaacctcgtgcataagtttatttattgaacttctctcatttaacttctccaaaaatcgatttggacttgtgctgttgggcatgagctaatcttaacttattagagaagtttaattcattttatcttcttttttttctcttctcctatgaatgtctgttgaaaagtttatccagataggatttaagtgcttatcaaataagcacttatgtatacgttataagcttattgaatgaaagataaaatagggctagcttgttttcttataagttgaataacgtattgaaataagcttacaagtttttttaaaaaaagttcatgaacatgtcaagctatttttatgagctctttcaaatatttatacaagttctcatgtcataaaataagcttaaataaactctttcaagtacactaaagttactactgctttcagcactgcaacgtgtgaaagctgtcccaatatagagcatgctaatcatttgtttacctcaatatagagcataaagaagtccgaatgtcccaaagaacttgagccagaagataggaggactgctgtccatgtcaacctcacaaggcgggatgaagactaccctgtattcccttttctattttttagttttttgcatctatctatcatcctattttaaggtttttaccatttctttttcctttcggcaaaatttatgcaggaaccagtgaagccacgccaacgtggtttccagggtgttggaagaactttaggtagcaccagctccagcaatgatgaacctattcaaacaaccggtgcttcaccaagtactgctccattgccaacaatgggtttagttgtagatgagtcgcagtcagtgacatcaatccagctgaggttggctgatggcacacgcatggtttctcgcttcaatcaccaccatacaatcagagatgttcgagcattcattgatgcatcaagacccgggggtgtaagaagttaccaactgcagtcaatgggttttcctcccaaacaactcgctgatttggaccagactatagaacaagctggtatagccaactcagttgtcatccaaaagttgtaggttatttaccagattctattttcagtcgacttgaaattactatttttatgcttaaacattgattgatctacttatattttattagtgaatttgataaaaatgttcattgttagtagattccttatcccaaatttgcttttataagagaaatgttgcgtgaatggagaaaaaattactaggaaaattagtgcctaaaactttgttcggccacaatcaccccgtaaggtagttgaaaactgcagttggtttttaacataattcgtgaaaaagggtggaaaaagcctgaaagtagattatgtaatttacaaataaagaccatgggaaaaacactaaacagtatgtaaaaggcccagaaacaggtgtaccccagcgcattgcgcagggtgatgtgtagttcaacttatgttttggttaagtgattttaagaaatcgatttttacattctaattgttttttctttcttcaatgattcccaaataaaatacaagaaaaatgaaatcaattgttgatatgttgtaaacattttttgaattactatctgcgtcaatgtattctgacttcttaatttcatgtgaaaggattatatatgggctctatcaaaatctgtactattttggtagaaatcaaaatctgtattttaagcatatgaataaacatacaaaatatttttttaattgctagagtttttattttgttacaaaattaacagatctattatttttattactttttcttattgaacaataatggtggttgcatttcttataggttatagcacttttttctttggtatgtttagttaatgaaagaaattgaaaggaaagttttaagttgttaagtagaaataaactgaaaggaatatatatatatatatatatatatatatggaatgatcaaattatactattataattttgataattattatatcatttttataaattaatataagatgtgattcttatttatttaaccattaaattatatttatatattatcaagattatatgtgttaaattttatcaaaatttaacaataagaagacaatcaaatgatttatattttattatattttaaaatgtttatattacattggttttaatttatatcaacgaagtaataaataattttggattaatataaaattttgcatatatgatacatgttaaaataattttcaatccaatggtaagtttgaagaaaacattattcaattgaaatttataaaataatgtaataattgttaaagttatatcgatgtaatttgatatatcttctctctctacatgtgtgtataaaatgacattcatattctaaataagtaataaaatgtgattgagatatttttgtcattctaattctaataataaaaaataaaaataaaaactatttccattacgttcaagccatttttttgagaccaacaagtcatcctagtgaaattgaatttaattttctgaaagaaagtttctaatttgaaccttgtggattaaaaaaatataattgaaagaaaaattacaatagtcaattaaattttcaggtagagattaattatcaagaaaattaatgaatattttatattggtggaaaaaaaaattcatttgtgagctgaatctaaaatgaccctacctctcatttgtataatctcctctcctttgttcgctggccaaaaaaagaaatatatgaattacaataaaagttatttagtgcctccattactctctttgatctatagtatcaagagacacttgtatcttcaagaggtatatatttcttttttttttttttggggggggggggtgttaaattgtaattctatgtttcttattaggatcataacttttattatcttcaatgtgaaaattcatgaggttttattatctccaattaagttccgcatcctaattttgatatccgactcattgtgccgtgcaccagtattatctggttaaagtgtaaatagttgataaacagtgttaagtagttgccaaggatgttatgtctataggaaaaacttgttagatcaatacctcataattgtttgacaagcaatttcaagtagacaatacaaaggaggaatgaaaacgacaatacaaaggctttgatattccacaactcaagtagagcaatggcctgtttggtgaaggagcatattttagtcctatttcatgatatttttggatggaagtcaaatcatatgaaacccacgaaaagtcattcctctcctttatttctactcaaaataaaatagtggaagacatttatttttacccttctttcttcctctcaatttccctccaaacagagtgtaagtgatcaaagtattaaagacaaaaagagacgaagatagcgaacaattgaatgaatatgaaaagaagtggatgatttttgtacgaattctatccatgtgaatattacaaaatgacgtaatattaacttttatttactttctggtatatttttagctatttcgtgttttctcttctcatccaatgattggttgcaaattcattcgtgtggctttcataccaaactgttcagacggaatatcacaactcctaggcataaaataagagtggaaagagtttgacatattttctattctgttggtcaacgttttttttttgtcaactactacctctctaagaaattccagaaatgtttttccaaaattatgttagcactccgcaaaacaacagttattccggaaatgctttaatggaattatgttagcacaattccaaaaaatataactttttcccaaaattgagtatgggtgagtggtcgcacatgcacatgtgggtgatgaatgggttgggatttgattgcgccagaatgagatggctcagcacggcgttggccacgatgatgtttgggtggttcgtgggtggtgaatcttctggtgctatgggttaggtggtggtggctatggaagattttgagatgggaaggaaggacatatttgtccattcaagttttctatggggtgcatgaagcgaagaatgaggcgcagaaagtaaaaggcgagtttatcaccaaaaggcccagaaaaaaatgtttatcacaaaaataaaaataaaaccagatgtttaaaattatcatgtattggttgataattgatctgaaatataaccctttttacagattggacctcgagcctacaacaatttgatagcaagaatgttttgtcataaaaaataaaaattgatttttctaatagaaaaaagtgaagcatctacagtctaatcagctagtcattagtcattatattattttgttaacttttcattttttgagctgatgttctttttgcaacatcactgaatgtaaagaaaatgacaatctttttcattctaactgccccatgaagaaaatcttatttcatgaagcatagtaacatatatagatttagaagtcattatccaactcaatcacggagaaaccttcagggttactctctttgttattacgttgtttgtttgcattaaaattttaattttatatacgtaaaattaaaaaaaaaaatgacttataatttatatacgtaaaattttatacaagaagattaagtcattttatatactcgacttaatcttcttgtataattttaattttataagtcattttatacaagaagaataagccttgacatatataaattaacaagtcattaaaacttaagccttgacacataattttattttattaatttataagtcttaaatccaaaatcttgtacaagaagattaagtcgagtaaaagtccaacaatgacttattaattatcatattcttaaatacaagaaaaacgttctaacaccaaaataataataataaaaattaagaaagaaaatccttcagataaaagacacttcctttaaatggaatcgagatctccttaatttccttccgccttttatttatttattaagatatatacattattttgacactaaattctcgaatattgttatagtggtacaattgagagacatctcatgtagacataaacattcttatatatcatcaactatatatcgggaaaaaaagtatggatatcttttaattttcttaaaaacttaattgataaaatttgtcaatcatagggtacaagtggaacaagctactttatcatgtctgtaaatagtaaatcatacgttatttacagtaagttctaaagcaattatattattaaacgtatagggatatccgatccatgtcttggaattatagaatcctaattcttcttcgaagttgacattatgatatttcttagataaattcaccattgattctgtgcgattctgtggactacatggcattgcatggttggctaaggatagtaagtaaactccaccatatcattccgatgaggatgggacttagcagggtgatgaactcaccaccgacaaattaatgttttttattttaattatcatggaaatgacgtaaaatatttatcaatttttaatagattttttctcttaattataatttttttatcaacaaaacttaaactcaaaaatttacttaacaaaataatagtacccagttttacactatcaacaacatgttggttttaaaaaaataatgttttgtttaaattagaagtgaaatagatagaaaaaaaaagtaaaataaaaatatattgtttgaatttgaatggataaaaataaaaataacatacaaaaaattctctattttttataagcataaaaagagtgaaataaaaaattaaaaacgtaattttataaataataaacttaaataaaaaattatataattttttatattaattaaatatttttttactctactatttttaacacaaaataaattatttaattttaagaaattatatcactaaaaatttatttaactttttaaaaaataaaaagaaatgagagagagagagagagactccataaactctccgcaaatcatccatgtccgttgtccaacaaaggggtaaatatagaaaacaggagcatggtgggggtgaaagaaaagtaaatattctcttcttatttttttttaatatttagacattttaagtgattttttttgaatagattaaagaaatgagttatttttctaataatttattattatgtatacatggttagaaattaaatatctactgtcatgcttaaccgatgcaattatctactgtaatcttgtataaaagagtgatcaaatatttaaattattccaaaaattaactctgaaagggtttttttttttttatatctatcctttatttatttatttattcaaatacttatcctttatttaccaaaaaaaaatattatttagattcttttatcgtaaatttattagataaataaaaaaatagagatgagcattaactctttgatctaaagtcaacagtatcttaaaaaaagttattctttgatttcatcttccatcttctttatctaatagttaaatataatatatgtaattcaagtgggactgagcccaaatcccataagatctcaatttagagtctcgtaagatgaaaaatgtgattaaaaaaatatttataaacaataattaatctaacttttaataaaattaatatttaataaaattgatgaatatcattcgtcaatttcatgataacctagtaaaaaaaaagataagttattcgctagaatgatagattaaaaaaatgaaaaataaaaataaaaaataactctttattaaaatcattaaattaaaaaaataattaaaaataactattttagaataatttcatcttttttctgtatattatataatactgatatgaaatttgttgatcaaccattgaattataatcaaatattaccttcattattaataatttttagttaataaaatattaaaagaaaacatattttatattactttattcacgcacaagtattcatgaaaagagttaaatttaaatttataaaaaaataatatataacttcataaactcttttaattcatgaaaataatttttggtataatttgtcacaataattttttaaaatttttatattcaagtttataatataaaatttgtgtaataagatttaattaattaaattatttactcaaattcacttacaaaagtttctctctagaggtaacttaatttatatataataatttattataaaaagacaatatggagatttttttttggtgtataaggttgataaaatgagaacagaaaatttaatacaaattatttaaatttttgcaccattagattagcaccaatattatttattttatttaatagtcatataatcacaaataacactgaatactatttctggttctatttaaaagaaataagttatgatgcattttacattataacttgttttttataaataatattagagataatatatttataagataattattgtacagtataaaaaaagataatggctgtaaatgttctaaaaatatataagtattgtaaaaaataaatggtaatatgtggtgataatgtaaaaaatattttagactcttagtacaattttgtttttgctatataaataaatattgtattataagtaaatatattatttattgagaaagaaaatggcaaaacacaatatgtcaaattgtcaatcattcgtgtagggtaaggtaagaaacgcaatagtaatgaactgaaaggaagggacgcaggtagtgtcccacaatgagggcaacatcttatataacatgggcttcttttgctatgtctatctcttccaacccatttttctcctctatttttttccatttgattagattgacatgacccctctgacatatgtgtgtctttgcatggattccaatttacaaaacggtgtcgtcttcctctcattaacccaccctcctagtggctaatatataccaattccatcatactaaagcaaaagtggtatgtgtgagagagtgataaagatccaatatctcccaaaggaatatcacatgggtgataggtgtcgatggacggttgatgtttgattcctttcaatcacaccaacacctctctttacccctacaacttattagagtgaaactaaaccaaaaaccttttcatattatattatattatattaatatcaatatgtttaataaaacttaattaataacacgttaaatttattaaaaagacttaaattttattcctgtcaacaggttttagcactttgcgttattctaagccactgagttttgatatgattccaatcaaactaacaaaaaatgtgcacatctcaatctaacatagtacttgttaaaaagttaacttaatcctttttgttatcaaaagttatttcttaattgttgcacatctatatataaattaaatcttgccaatattcttaagaatattttaacacttaagcatgttaaaaatggaataaatataagacaattaagaagcataacatataagtacgtaattaatactagtaccgtttttactttggatataattttagtgaaagagtgaagcactttttctctctcctccatttccattaatttcatgatgtgagtgtgactgatagatagccaacaatagtactacgcataaacagtggtagtgcatagacctagctagctaagagggtgagtttcacattattcacatacatagatacatcttatttcattgggaaggaaaactctgagttaagttgcagaaccacacgttaaccctgcgtgtagcctgtgtgtctccacctgcattcaacacacacagcaacagcaacagcacactggtagtagtgtttgagagagagagagagaatgagattaataagaagcaaagcaacactgttgatgcacagaaggaagaaggtagactacacattcccaagggcaggactctgaaatctgaatctgaatctgattcccaccaccttttacaggctatagagccaagagcccaaaaatccctattgttctgactgactatccatttaggttctttggagttttctacaaataaaggacccagattttttagcttcatttccgggagtactctctggacaattatatgcagtgtgctctttttgagaaaacagtaaggtggggactagtaactaggaacaactgatccaagccaaagaggtagtagagctacatactcatacagctattggttttactattcctattttactattactattttataatataaaataaatacatatattatatatgtagcatgtggagttttagttatttttacatggtgagagagagtgaaacaaagagagagagagagagatagcactttcattttcgttcctttcaagggttttaactacacaacttattattactttgaaactatgatagggtttggagggaacagttgcagtgagctttctgagatggacatgatgaacatggaaactaataataggaagtttctttctctgcctctcagtaacaacaacaacaacaacaactctggtaatgcccaaatgcgcagaagtagtgataatagaagggtacctgtcactagcaatagcaatatcgctcaggaacatcactacagccaccacaaccccaccgacacttgcagtatgagggataaaatcatggcacaccctctttttcctcgtctcttgtcctcttacctcaattgcctcaaggtgatgataaactctatattgttctccatattcacataaattacacacatctctttccctttcctcctaacacatattgtccttatatagaatgtataaggttggtttagtggtaaaggaagaagaaaaggaaaaagaagttgtgggtttgaaatctcgcagacaaaaactaacaatattaactaaaaaatattttcgataaaaaaaaaaatattccttatctatatgatcatacactcttgtaattaacttgtaaactataattgcactcatatctctacttctctttcatgggtttcatgaggactcaaatttcctgttgtggttttgctttttgagatttttgtttatgtgttttcatgtttttcttgttttgatggtgtgagtggcgtatttacaggttggagcacctccagaagtggtggctagcttagaggagtcatgtgccaaatgcgagtccttcaatgcatcatcaggaaggacaggaggtggttcaataggtgaagatccagctctggaccagttcatggaggcctactgtgagatgctcattaagtatgagcaagagctcacaaaacccttcaaagaagccatgcttttcttctcaagaattgagtgtcagctcaaagccctagcagtttcatcagattttggtgattaattacccttaaatcattatttgttcctacacttctctgagtactgtggagcaattatggactacgatttcttgttttgggaagttggtgacaaagattgggtgtcagtatatgtgagagtcaacttaattagtaatccatgctcgtgtgacctatatatattatataggagagaaaaaaaagatgaatgaattagcaacacaatcgtggatcgttgttttaccactatgaaattattactagaaatcaaccctgtgtggaaaggttttggttagaggctaagtaagtaatgttgaatcacggcttaacttgctatacccttaggctagtggtagttcttctgtctctcaaagtctttaaaccctctggaaatatgctgcaagcattgaagggatctatgaccttgctagctagtcactactcataactctgatcttcagaagcaatattgtctttcaaagctaaatgttggtattaactattaatattaagtggttgagtaattaatgataaccacacagctgatggtgcaattgataccaataaaaaaaggaaaaccacacctgcctatgctggataaatgtgtttttactaagaatgatgtgatgctgaatttgtttgtttattacatatcatcatctgaattaattgaaaagagttagtcaaataacctttctcatcgtaaatagtgtgattagttataaaggaacttgattaaaaacctttacagtgtttttaagaatggtaataataatgggtccaaggtgtttgaattaggtcaaaaagtttgaaaacgatgattaatccatattactgcttgaggggaaatcaagaaaaatgagattttgttatattattctaatgataaaaaagtttattcttaccccaataatatatgctgcttaatcaagtgacccattgataatcttgatggctttcgggttattttttaaaggtatttttctttttggttcgtgtgaccttggtgttactcattatttcatacgtactcagtgagttgtcaccaatgcaaggcattagtcttctttctttctgtttaattcattctcttcatttagattcatggctctctctgtcaaagtccctttaagaacttagttgaaaaaggaaactccttgtcttatcttatgttgtcatatgtttccttgtcaatttgtttcctctgtagcttaattaaaaaaaaaaaaacaatgtaaattttgagtttgtatgattattttgttatttccttccttagtatgttctctggtggtggaggaaagggttacatttttagctctaacagtgaaccatatctcttgtttataattgcttacttttttttagtaaaggttgtactcttaaatggccttttataataagaagttatctgtatgcatggtgagatacattttgcactgatctaaagttcagttattttctttgcaactttctcctatttagtaacaaagctagtgtgtaatacagaaaaaacattgcaatgaaatttagtttttaacatgtttttgtcatttcttaggtaatgcatgttatttgatagttcagaaaaatgaacatataatcttaacataatgctttctttaattgatacatatcaaaattaaataatgttatatcttcctatcatattattctactaatcctcttaatactttattaaaattgtattaaatgaataactaaatataattaatatcttataaaataaaaataaaaatacttactttatctagtaaggggattagtatgatttagaattatttgatgtattatttctgtgttaaatgtcaatagttataactgacatgcaattttatgatgtcaatattttcatgatggatatttatttgcatgaattgtttttactgataacttttaattttttattccattttgttgtggcaattttaaggtcaaagtgaaacatcttcacagaatgaggttgatgttcatgaaaacaacctagattctcaagctgaagaccgcgaacttaaagtccagcttttgcgcaagtatagtggatatctagggagcctcaagaaggaatttttgaagaagaaaaagaatggaaagttgccaaaggaagctcggcaacagctacttgattggtggaacaggcattataaatggccttacccttcggtaactaagttctacatcctttataaaccatagagaaatgctagtaacatttttttttaacaaactctttattgattatttggctgaaaatgattaaaaatcataatatatgggtcacatttcatgtttaatgagtctcatgtatgattttgtatttttaacatattttaattaagagtagcgtgtgcgtattatagagtgtggttgtacttctctttatagtttataccatgccttcacaatgtgtatcttgataaatactcatattttcatttcaaaataccttgtttcctttatattttcaccaaaatatagccacatttggtggtgctatagcctttggtattaattagaaaataatcctggtaatatgaatttcaatattgaaacgttaaattgttagtatgttggtatcaacagccaattgtgcattaattaattcataagttttgtttactatttatatatatccgatgactaatcttatgttatggcaatggtgaatgtgattggataaacatgtaggaatctcaaaagcaggcacttgcagaatccacaggcctagatctgaaacaaatcaacaactggttcatcaatcagagaaaacgccattggaagccttctgaggatatgcaatttgccgtgatggatgcaactaactactacatggaaaatgttatgtgcaagccgtttccaatggatggcatgcctatgcttctttaactcaatcctctactagaatattcaaaagcttagccgagaaaaccctatctattttaagtttcctaggtcgccaggttgctatatttaatatgtcattgatgaatgtttactttaaattgtagaaagcaggatgaaaattctgtcatccctgaactgcaatctatgttagtgagcgtgaatccaactatatgctctattatctacacactgtttgcggagatcactagagatgttgtgtatgttttgtttcctaatttaatgaaaatgatttgttttcatacgtaaatgcattaaactgataaaaaaaaaattaatgtactggaaagaaacctaaatggtattgattcatcaatcgaaggacttttttttttttaaacaacatagtcttatatatactcatattttctcacatcacttgggttaagcaacgctgttgaacacattagttgtacttaactacttgtatataattataattatcgttgtccaaaattttcttgattcacgtgtgttgcatgtctactatatgtgtgcaatatagtttgtttgtgttatagaaatgttgtggtcgtacagtgttggtatgcggtcctcatgactgagcccttgttgtttgcttcttgtaaccaaggttttcgatcatttggagcagcaactaatgtttcttttttttgtgtgtaaacaaaaacaacgaatatatgattatgactgagaaagattatcattattagatataaaattggtttgtataaaatggtgtatatgtgtatagatcgatatgtggaaagagggacagagatcgaaaggtagattttacatcactataagaatttttttttcctttttttaagcccctttttaagtcgggtaaaaatagtttattatttgaaaggaataaatgtgcacatttaaaaacaatcagtaggtattcatataatattcgattattaaataaataaataaaagtacacaagcataagaatttaaaactttgaatttataaaatctccaaaattagttaattaatgcagtaatcaaaattagttaatgaactaaatgttattttatggatcatttatgtattatatatcaatgtctcattagtggtagtgagaaaaaagtaaatgaggattgtacaattaatcatggtaatttgatataaaatagatcaaaaattttgtgttacatatcatctcattcacatgtttataaattatagattatgttggataataatacattttaattagtttcaccgtcagaaaatcaaattattagttctaatcctataaatctttcccaaattcaggaggtcgcctccgaataggagagaaacaattcttcatcatagttggacagtggagcaaacagtttcattatttaaatttataataacacatcaaattattgctccaatattagattagatcaagtatatatggtgcttttagaaagtttctctgttcgttaaaaaaacacaaaatgtataggagttatattaaaatttattttagaaataattatgttactttagaaaatataatactttttgcaatcttttaggaagctcattttattttggttaagcttttaatagtaaatatacttatgccttcatttggtcactcacgttcatgtatgttattattatttttggattaattaatactatatatagggtgtgggaactttgtttatttgtagcacttttcatgcatgactttggatctacatacaaatgattttgtaatattttgatggtttacttagacttttaagaaaatgtaagattttttcttttcataaagtatatttaatatgtgcataaaacaaaaaaacctatagaaacattcaatatactatctttctttatatgttattgatagtagggcttgatactggttatttgttttacatgctataccgaggtaacatacaattggtcctaatggggttaagcctttctatgaagactaatagcattttataatttccttatgcaacatgtagtaacttgtaaatttgtatatcttttgaaaacattgttgtgtaaatgttgtatataagtaccagtgtgttaccccatgcctgatacgggtgatatttacttatacagttatacttattgtgaacatataaaataaatattataataaaattttgagaattaaattgttaaaattattcagttaaaagatttgttaaaattataaaaaaaaaattaataactttgaaaaaaatcaatttttctttagattaaaaaatataatattataactgtaatacaaatgcttctttaaatgagaaaaaacttcaatacttaattgagaagcttcctatccaaatttataaaatactaaattctacaataaattgtacatcaagcctgcattttcataaatttcctagtaatattatatataatcttcaagttagttctacattagttcctttttttaaatgttcataaaataaatttattaaagacaaaatttctctatattaatcttaaagatgatttttgtaagaattaatatgataacatatgtaataatgaataattgattaacgttgaatttctctctctctctctctctctcgcaagaatagaacataaaaaacacacattaaagataatatattactcaacagttctaatttaaccatgatcattcatttaaaaactaattattccagacagagttagcaaagtgaaaaactcaggtctctatatgatttacgtgaaagcatgcaaagataaaaaggggtgatgtttttctttgttaacttctcacctctttaacttataactcatcaattatttttctttttaattcattcaaaactcaaaatttattcataacaaaaattgcaggtggaaaaaaattacattaagctaaaggtgattgatttgtatatttaaattaattatagtcacgaattttattgacattaaaaagtgtgtcacaatctccctacaaataaccatcagacaaccattatttattagagctgaaatgaaaaaaaaatgtgtttgattggtgcgtttgggacaatagaaaaaatatataattagattctttttaaaacaatttatcgtatatataactaattattgttataattaattataatcaggactagtttttgtttaaataattttactgaatttttttaaaataattaattttatttagatttaacaaaaaaatattttttacataatatattacaaaaaaagatatgtataaagctgaaaggaaatttttttagaaagtttgaaataatttaggaataacgtgtttgaaggcaaacaaattgttgaaaatacatcgtaagctattacactataaattaaattatcgcaaaacattttttcaagaaaaaaactttcttttttatcaacatgatgtgcattgtttacactttggtaatttcataatttacctttgatataactttaaattaattataaaaaaattaacaaatttatgatgtataatgagttataattaaataatgatgtacaactttttaaatgcaattataaaatttaccatcaaacttttattattacatgaattttactactctagttttatttttgtaaattttatcatccaatttttataattttttgaattttaccattacgaattttatcatccaactttcaacattttataaattttattatctaaattttttatttttgtatatttttccattacattgataacaaaacaatataaaaaaattatttttttctaaaattttgtatatatgtaattgtgatcatgtcaaaaagtaattatctatatcattgtggtcatatctgatatagaaaatcacattttacatgagttataattataatcgatattaaaatttaaaataaacaatcttccatcaactataataaaatgtaatcaaaatcaaaattttgagtgataaaatctgtaaaaataaaatttgttctgataaaatttacagaaaaataaaaattaaatagtataatttacaattaaggaaactttttacctcaccaatgtgtgactctttttccccttcgaaatctgttgaataattccaaataatccgacccgacccgacccaggtcgccaaaccaaacctcatagcacagaagtctaaactgtgctttttgttggttggggcgttaggggtttctcattttttatcccaaacacttccgtcagtggtgtccgcatttccttcccgccgataaccttttcgggtgattgttcttcttcgctcacgcaccgcacgcgtaacggtaatcctttctctctttttgattcttaacttgaagctattcacaacttcacatttagtttgtttgtttgttttttcagtagttcattccctttgttggttccaatttgcaatcatgttctagtttgtatccataattgagtctcctatatcacgttgaatcgtagttgataacttgtgttggccgggttgtaacggctcttgtgatttatctaacttgcgtatctgcctaccacatgtttgataaaatgcctgagctaatgtcattttacatatcttttagagtaaattgcacttacaccccctgaggtttcgtcaattttctcccgacgctcttcttttttttacccctacgctaaaccctcttaattgttggaagaacattacgccgatacctcttctacattatattaacgccctttattgtttgaaaacattacaccgtgtacccctttaaggtggttgctttaaacgttaaaaataaaaatacaaataaaagaagagggttatgttatgtgtaatctcaagaaattttaggagattgtctgtgtaatttactcactcttttattatcatcttttttaatcttttcttgtttcaatggcaaggaggttttataaatgctttcttacctttccttcactactttatttgcatatacttttgtcactctctaactgttttcttcaatgtgagttattcaaggtaagattttctgtctgcttgcatcaagtagtatcaaacatgcagtattggagttgaatgaagtgtatggattttgtttcttttcttatcaagactgattttacttaaacttgtttttttatctgtttttgtatgataattgtttaattttggtatctagtttgagtatgaaaaacataataacttgatttgtttcttaatgctgttctgacttcaagctgaaggcatgaatgcgttcaaggcatacaaggcctgtgtgccaattgcttggagccccaatatctatataactctggtgaggggtattccggggaccaggaggctccataggcgcactttggaagcacttcgcttgcgcaaatgcaatcgaactgtcatgcgatggaacacacctacagttaggggaatgctccaacaggttttagcaaaagctctacacaagtccattttctgcttgatatgacttatccctctgtatactaacattggtaaactttgtaattaatataggtcaagaggttagttgttattgagactgaggaaatgtacaaggcacgcaagcagaaggaagaagcgcacagagctctacggcctccgttggtcataagtcacagacctccctcggttaccgatgccttataaagtcttctgcgttcttaaagattttatcttcttgatactaaaactatccaatgccattgtttaaagctttggtctcaaatggactaaattttgctttcaagatcatgtcatagtttgattctacgattctgtagtgttttctactgataacattagtcaaattcaggcctctgctcatgaaacctgtctagcaagtgttcatttatttatatctttagtttgggaatatttataatttattccataattgccttttctcttttggaaacaactcactgtcgtttgccttttttttatctctgtaaatacttaattatacatcacaattgtcctcgttaaatgaggtcgacaaaatacccaaaaattaacaaattcggggcacaatgttttgttcttacacactatatattgggccacacaaaatgagattttaagactatatcttatgcttcttccttttcatcaactccaactttcacatcatttgcactcacaagctctttgtctgcatcgtcattaggctttatgctgttctgaactttgtactgatgcctcattgctaatacaagaaaaaatatgaaattcagtactcctagcactgcgagcaaccaatagaagtaatctaacctgcccttgttcagattgctccttagccatcttttattacttgctttgtccacaattgccaccaataagctactgacaaaataacccattgaaagtgtagataggaaaagtccagtgctcatagatttcattctctctggtgcctccctaatgaaaaattctagttgtccaacataggcaaatgcttctccagcacccaccagaaaaaattgagggaccagccaaaaggcgcttatggtattattttttactgcattcaccctcctttctttctcaaccattgcagcaaccgccatggcaacaatggagaaaacgagtccaattccaaccctctggagacttgtgagcccttgggcattgtgggtgagtttccgagctaagggcacggtgagtttctcatttagagaagtaaagaggagaatggtaatgatgagaaaagctgatagagatcctgctgggacgactagagatccaacttttcgattcatgaatgtagcttgctcaatggtgaaggtattcatttgagaatagattgtccagaagaggatacatgtagaccaaataggaaggagcttgattaccattttaacctcctcaacctgagtcactgtggaaactatccacgggttttccttgatttcatcctttgagcagttctcatctaggattgcagctttgtcgaggaacctgtcagaccaaatacaaagcagtgaaaatacatgttagcttactatttccctaggaaatgaatgacattattattataaatcgttccttgtgttttcaccgaagaatcaattcatagctatggacacatgttgattcaagaataaatatggtatcaaattagtatcatataatccaaaatttgttttaaggttgcagttagataattcaatctaaagcaagatgtttggatatattatttttgtttaaatgcttcaaaatatataattcgtcatgcaaaatgagtaatgagtagcatacacataagaaaaatcgatctaataggatcggcctcgtcgtaaaaaatttaggtaatctatataaatttttatgtttaaaccttatcagtattatttattatatcaaaaaaaaaatattagaagatatgtgcaaagattaactaaaaaatacttatggaattttttttaacaacttcataaattgagagtgtgtgtgtgtatatatatatatatatatatattctatgtcagttttaatatataaatgttcaattaaatgttattattatattatattttttaaagttttctttttgtaatttcaattgcatttccgattctctttacccatgcttcattctcgtcgcctgtggaagtggaaggcctaaacacccaaagctaaatgctatgttggatcattaaagaacattaatatctcataattgtttttgagtaaatttctatattttgatctcaagttgaaaaatgaatttatggtctaaaactaattttttactaaaataattttagatagcttctatattagattaaaaaaaacagttttcgttgagttttactattaataacttatttttaataaaaaaaacatttaaataaaatcaaattacttaacttcagaattaattacattcaaaactaatttttacaaagtgattgtttaaaaggtttgtgatctgagtggagcacagagtagtgtgtagctggaaaaaatacatgtatcgtctccattgtgatttgagtgagtgagtgagaaagatctgtctcatttctattcctcgcaggtgacaaagatgtgtcaagatgaaatatgtgttcattggcagaaccatatactaaaaaagaaaaacttttttttgttttgttttttatttttaaaaaaaagttttcacaaatcactttacaaaataaattttgaaaaaaaagggcaaaatactattcctttccaacagacgctgctcttttttcgttttcacaattcctttttgaggactgttcaatcaaacgtaaaattgttccttttctagagacaatacaaacacttatgttgtcccagatagtaatagaaatagtaataatcccgtgaaagtaatcattatcagaaccacaaaaaatgagaaaatcttttgaaattgctgtgcaataattgaagaaaaagacaatccagcacaaaaagagtaaattaccattttggtacatggaagtataaaattgtcatattaattcttaaaattaagaaatttttattttaatctttaaacatatttcacatgatatttatgattacaatttgaccatacggactgtggtcaatcccaatacaaaaacttatgttaatagccttttttatcagtagtatgtccatcttaaatttagactaatatgattaacgaattacaagaactaatattgtaaatagtttactcttagtcatgttgattgctttaagaggaagacagaaaatttacctgaacctctgagtatgtgggaccttagcttcaagataaccattgagaaaggaggattgtgaaggaataggaagactcctcttcttccaagccaaaaacagcactctccatataattgtcaaggggcttccttgtggcctcttgaatctatagaatggtgtcccacaaagcaaaacagcaacagcaatcaccattgtccctgctgaaattccataaccccaccctctccctatgttgtcttgcacatacaccagcaccaccacagagaacaaggaccctatgctgatgaagaagtagaacctgttgaagaaaaacaccatccttctttcctccttggggtcttttgaatcaaactgatctgatccaaaacctgagacattggattttattcctccaccacccactgctactgtgtaaagtgccacaaatagcaaagccatttgtttgccactggcctgaatgcattcatggtgttgttttctgacactgctgcatacaggaggcctcatgctaggaatggttgtagccacagttaacaaacacaccccctagtccaagaaagatgtgacaagaaaactagtttgtgactgctagtatggctagtaatatgctagagtaaatagtgaatgtaattagttacttacttttatttttgtataataagtttattgacttttacaatatttattttataagtcatattaatgatgatgtttatttctgattgattgatagttaagtgcatagaaatcaaactaagaaaattatgttatttgcaattgaaaaccactttccctagagggaagggagacattggttgctttagtgtgattaaaagccaaaagaaattagagaattgagcattgagtatatctaaatatgcaaagcttttaacataccaaagcagctatgattgcagatatggcaacagttaagtatctgccaagtttagcatcagctatgaagccaccaagaaggccaagcaggttgagagttcccatgacattggtaactatggtggcagaatcagctgaagggagattcaaaactccaaccaaataggtcactaagttcatgcttatgcccatcacacatattctttctgccagttcagtacctacataaaaaaaaaaaaaaaaaaaagttatgtgttggagccaaattgaagagcgctttggttcaaccttgaaaacatgactaaaatttctatggattgagatgaatatgaacctaagatgagccctgctgctagccatcccccagtttttgtcttgtccacagggtggcctcgaaaatcaacagtagcaatgccttctgcccctttttcctcctcgccatgacttgcaactagaacctagaagatagcaaaaatgcaaaaatcattaagacatcaacaaagtatagaaataagctttgaacaatcaaaaagggttcttgaaaatgaagttaacaccatgttttatcttctgttggagggataactgaggagagttttgctgaagtgcgtgtgtgtttcagcttcaagagttgcaacgtatagaaagtggtatgcaaatgcaaagttaattagctatgtcatgacaaggacaagtttgataagaactagtttgtaataggtccacttgatgagaagatgagtggcctgaaatgctgaactgcaaagtttgagtccgcgtgctttggagttttataagctattgttgtgtggcttaagaagaccgtactggcctaatgaaaacaacatcttgggaaagtgatggaacagtataggcactcctaatttgccatcacaaagtcacagtcgtagtgaacatatgaaaaaagaaaagcttttacaaatccatgttcttctgctcctcttgctttatcaagtaattaccatgatgaacaaacaattaattggacgatgaaggtggattatacaggtacgtttgtttgttgcatcagcaaattttaactgagtagttttagttgaaatttgaaaagctatgttggtctatctgttacacaggaagccagaaattgaagcgtttggagaagtgcatttgtatgcatcatttgttgcgttacagattttctaaaagtaacatgctcaatgtatgttaaaggaggaaatgatccttataaacatgcaattacaacaccaccacatcctcttatgtactatgtgttaaaggaaaggttctagagcaatgtgagtgtttatactgttgattatacaatgcgtagataatacgagattatgtccatgtgactatgtgagtgattgtactgttgtctattggcaattttcgaagacaaaagaaaatgcatgcttctagaacaatgtggaaattacaatcaaattcttctttaaagtttaagtctaacaaaaataaaataagatatatagacccaaaaaaaatcaaaagaaataaagaaagaacacagactagaagtaaaaattctattaaaaaaaaaaaaaaaatcaaagagaggaaaggattaatattttgaaaatactaataagtataggatcttgctaacttagagcactggttaacgaattactagaaaaaatgtttaattggaaatatataagagaacattttaaaatcatgggttttttcttttatttctttaatcattgatctaactaaggagtattgatcagccttcgtcataatgattagcatttgttatgagtaaagataattgaaaaacttttctaattattaagctatgcttagataaaaattggaaaattttctttgtaaattccaaagaatatttatgaattttaatgttcaaaatgaagaaggagcaaattgatgatttgaaagtacagttacttttaagatcttcatccaaacatacatgcactcattattctgttgtctaacttaaaattcattttttaaaatctttaattacaacatatagtttgaatccaccataaaactgcatcaaagaacacttccatcacttgttgaactgaatagtttgactttgagcaaagttatatattcggagtgtagcgatgttgatgctttgttctttttctgttttcaaaattcatacattatgtttagcgcaagagagaaaaaaaaaacacttgtttataattctgatttttttatattatattttaataagagaaaaataaagtcccgattttttcttttatctttttgtgaaattatgtagccattttattatgagataaaaacgtattatctttcttcgttttttcgagaaaaaaaaaaagaacttaagactttgtgttctgttaaaaaaaaacgttgtgtaaattatttaaaccctccatgctagcctagtgagctactaccaattaacttaccactaattgtttatagtaaagtaattacagactgaaattcaattaatcaaagaatgttaaattcatttttttttctttgaaaagaatgtgaaataaataatataggagtaatttatataaaacaaaggaaatcaacagggttgagcttcgtggtatgttagtcccttataatatacttgtgaataaaaattcttagtcaaaattgaaaaatatattaatatttaatgttcgaaaatatgattatttttaaaagaaaacaaaaaagaaaaatatgttcatagcataatccaagattaagcttaaccaattaagaaacgtgtttggatataaatttctttagaagtacttttagaagaagaaagtaaaaagaaaaaaaatgaaattagcttctccataagctaaaatgagttttccattagttcatttgtagatgtcatctcatcttttagagaagttatattggtgagcttctaaaaattagttaatggagaacttattatggcttatgaaaaaactcatctcatttttttcttcttttaaaagtgtttctaaagaagcctacccaaacaggctctattattgttctgttgtcgaccgatgatttgtcgtttaataatacattgtataataatatattaagatgtgctaataatatttttttaaatacaattatttatattaaataaattatttaaaaatataaaattatacgtgtattcataaattaaaaaatgagacttttaatttttgcaatttttaataaatttaaactaattgcaaaaaaaaaagtgttctaagaatatatctaaaaatgtgttgctaacattcaatggacactcacaaccctaaattttttttccttttgctgtttcttttggcggagaattcccttaaactattagctttattttataaaatgaaaactttttatttttttaaaaataaattttgaaagagtactttgcgtaccaaagtaagttagcccccacctttggtatccatcggtgattaatacatgatatagatccaaatgaatcaaatgcaaagatattagtgactattactcgtaagcatcagacaagtgatgtaacaaaatttgggagcctaccttgaccctagttcgaggcaacatactctcacctcaaatttgcattatttttaaaacaaatctctaattattattatttttatttattatccacttccttattctaatgactatattgaccttatcattatttttattattattattggaattattattattattattattgactttaattgaattcaaactaactggaagagaaaataattatttgactacgtattgttctttaaaaaatgaccattctttgctctcttatcatctattatcttttatataaaaaaaatctctaagatttttaatatttcaatttttttaatgtgtgtttgatgacatgttagtaaataaatttcaaataattattcaaaaatcaatttatgtatataatatttacttttattttttcaaaatttaaactcaaacttcccccaactttggcagagagaataaatttgtctggaaaggtacttgatgcatcagcgaatctcatggggtgcgtgtaacaattagctcctgctacttgtcatcacagtgtgttgatgaatattaaaaatctaagctgttgcattgcatgaacgaacacacctactaaaggtgtatatattcgagccctttgaatgtttcttacatttgtcactttcagtatattgttcaagaaacggccagttaatttcgtgacacaacagaacttcaattcagacgcactcctatatcagacaatgatgataagaacctgtcttttcattttcatcaacactgttttgagaggtatgaatcgagcaacacgtacgtacacactgtcacacatgacccctgttgaattaaaaaaagaataatgttcttgtcttaagtcttaacttttgttatatatagttattaccggccaaaacgtgtattataaatcaactgaactggaatgatacatgggtgggaaactgggaatgccatgtcaaatttatagaataacacataagtaactaaaggacacttcgcatgcacgcgcatgtgttaattgattttgaattaatgtaatttgtgttggaatgttttttatcataatttatttctataaataatatatttgcattcacttattttatgtgattttttttatcacttatgaagcagtccattgtagcttttacgtatttaaacatttggacgtcattttttatgttggaacatgtgtccaaatagatacttaattgttcaacaaaaaattaacttaaaattattttaacacaattaattctaaacctaaaatcaaattttcaatgtaaaactaaacatcgatcctctaaaaatgtaaaattgcatatggccaatagtccaaatagagaagttagatttttcatatgatctcatctcttattatgaatagactaattatttttctaatattcttatattatatatatatatatatatatatatatatatataatttgggttggtcaatcaattaggatgtcctaaaaaatatacttttaatttttttaaatattctaataaaaaggttcttgtttttcgtcaataatgttagtctaattttttttttactctaacaacaattatattattattataatctttttagtgaataatataaaagaaaataatagaaatttttttaaaaataataattaaataatttcttcatatttttagaaattggagtcgaaatttacatggatataaaaatttatctaaaatcactaaatcttaattaacatcattcagtaaaatttaactaaaattaaacatgtatttcaatagtcatgtgcgccatccattccggggtacgtatatatccaaacacaggctaagactttatatattcctaagtgatgtgtgggacattttaatacactcagctcttacaatttttttgggcaaacacattccttaatcttaaaagggtatattttggctcatgtttagcctaagtattttaatgaactattaaacatatatattgtggagtatagttaacgatttctattttttaaagttaataaaatgtaacttaagattaatatctcaacaaatatttcataaacttactttgttattaatttcaaaaacgctagataaaattagtacaatattttttcatgttaaaagtttttaaaaaaaatacacttgacaaaaaaaaaatctatattgaattcatatcgcatagtaataactttaatctctatctctatatcaatgtaaaaaaagtctccatctctgtatcttttatacacctatatattcatacatactcacactgttacacatactttacttatatgtaaaatcaattagttgataaaaattattaattaaaaaatttctccaaattgaattgaaaaatcattctttaaatcatatatctaatcacacgacatgagtaatataatcatttaacataattattcttaaatataatattttaattcctaaagttgattaataatgcaggtgtacccattatcctgagtatttttttaagtacccataaagtattgatagaatttttgtcctaatgtgaaattatatttatgccttccttgtaccaagtcttagagcatttcgtaacaagtaaaagttctactttaattaactttgaagatgacaacggatatacttttatttaaatacaagttataaatgttttgggagatttctttactaaaaatataaatgttttcatcttaatttaatgaactaaacttcatcttatttatcaatggtcatgatgaattcaccatgaccatcgtcggaaggttgatactgttcagagatagttgtcatcatattgccatgaccgtcatgctcactacggtcatgttggatgtattaagcgttgtcatgtgacaaagtttttaaatctttaggtaaaattagaaatttccactctcttcatgctgtatcagatttatatttccatccaactgtagatgcagttccatcttgacctcgacctgcatttggaacgtgtgcaaaagactagatccattttatagaatacccaaaaacttgtagctctcaatttttacagaaaacttttactaaagggcaccatggacttctccaaattgttgcctcgaactctgttttttacgttctaaaagaactcgtgccaccacaatgttgttataaatcaatctgaccatttaaaaaacactttgggtttaactatgattacgataaagtttatacttactcctcaacaattaaaatatcttcgtagggtgctggagtattctgattcagattggaatattcttcgtaggatgtaattagcagttagattgttagataatagttagtttttgttatttttgttataactaactttgatataaaaaacactatataaaaggtgcacatatgtgtaaatataagagtgaaatatacaagttttcatttaaatttatcctgttgttatatttgtgcaaagagttttttctccaacaaacattaagactttttaagttttgactgttagttagaaatgtgtccatcgcatttatctgcaatattaacaaattcatctttgtgattgatacttaaagccctggacacgtttaagcggataaagtaataagtatgaacttgtttttggttttccacacgttactgctacgatgtagaattgtatgacatggaatgggaagaagataaattgtagtttgactttagagaaaataagaggagaaatgtacgattcccttgcttgaggggatatcccacacgagttgccgtctacatcatgctactagtttttaacttggaaaaaatgcaagtagcagacgcagaaaaatggataatgttgttcttacttatgataatttttacaataaaaaagataaaaaaaaatgtagaataaaattataatgtaataagaaaaagaaaaaaaaggtgttatgaaaatacaaagtacagattgttattataagaaagaattgtgtaccaacccataacagttgtatgttctggactggtgtatactctattcttctagtgttctcttctttttacaaattaattctaacgcatcgttgttttggacagtagaagatacattgacttcaatgaaaggacagaagctaaacgccaagaaaaaattacattatatattttaatttttgaatcgcaattattttatattttaaatttttaataatggtgtgccaattattcattgaccacaacaagaatatctcaaatggaaaagaccctctttcttttgacgtcaaaacacattatgggtgcaactgataatgaagcctgaggaaaaagagaggaagttgcgtatgaatatatgatagactttgttgacttcaggttgacttcctatcaggactttttggttatcatggctaaaacagaaagtaaatatagtaactttggccatagattttttattattatacagaataatccatggaataaattttttttcctgagaagttaaaattctatatagcaagttaaacaattaatttttcttctttattttttcattaccaatacatatttctctttcttaccatagagtgtgtaggaaaaagtgtaataaactgtgtgaagcagcgctacatattacatgtcttttccaagaaggtacctcaattcacttataattttctttttgttttctatctcttgatacaagtgcacaccaaatttgcaaatccatgttttcaaacaattgaacacaaacttatgaaatactaacaaattaatcacatgaagcagcacctaaagctaccggattccatcatggcattctatgcatcatatctaaatggctcaaccaccaattcactcacaaaaaaaccaacttctaagtgtacctattgataaaggattgattagtggaaacagtacaagaataatctatacattttattgacctataaccacggatgttaaatctacaaaggagaagagataataacacatgctcccttttgctgactgtgtacatatctacgattgtcaatcgtgctttcttttgcatctttcaagtcggcaaagtctgaagcaagtgtaaactagcactaggaatgaaacaaacatcactgcaacaaaaaaaaatgaaaattatcccttgaaaccaaatgatagtaagcaaaataccaaaaacacaaacaattcggttttaatcatactatgcatggaaactttaaaagagtgaaatccaaagtaaataacacgcatgtgcgaacacatacagaggatcagaggatcactagcaagtgcaacttagaattgacttaccaaataaggtgaaaaagaacaagattgccaggcgatatcttacaatccatggtagactaacttcaagagtgcaatgctttgaattattatgctctgcttttaccctgtctaaaatctctgaatttgatggttgtaattccgttaatgaaacatcaacgcctgtaactgtgacactatccttgtccctgactttgaatttcaaagtcactgggtgagagtcccaatctatttcaatagttccaaagtttggctgacctaatgaaagtccacaattgaaacatcaaaacatgaaagccaatatacagtaaatattcttacccaaaaataaagaagaaaagtttaccataaatacaagatttgtatctgcagttttggtccttaactctcattgtagatggggtcaaccatgccacaaatctcacaaaagaacgcaagaaagatgggacaacctcctcaactgattgagtaaccccacttgaggttaaatcatatagtggatagtccaaagcacaatcatatctcgtgatttccccaaagtgaacatctccactaataaaaaatactccagccctctgcatagaaaagactaataagaagtgaaatgagtcctcactacagctacgtaaatgataccaaggtaattccctttaacaacatagatgtaaaacatagaaaatgaatgtactgaaagttgttaccttactatcagcgattaatttaaaaaggcgatctctttcctttggaaaacgaccccatgattccattgagaacaatggatgaatggttgctgaaagatttgatataacctgacatagaaaagaatatagaaatgatttcatattaacaacataaaaacgactctcaattttccaaggtgcaacaattcaagcacaaaactgaattatatattgagttcagcaagatcttcatgagaaaagcgcccagtcaaatatagatatacagtttcaagaatacaggcataataattgataatgtagacaaaactcaaagatgcagatgtcatgtaataatatttatcatgtttagtattttgaataattcttattaatctctggcattataacaattgatacctaattgctgtacctgaatagaagatccaattatggtgagagctgttggtggacccttgagctctgtctccaaccacaaccattgtgaattccccaaaatggttccatcacttcctacagggtctctgtgatatctggtatctaagaggacaatctgaacagttttccccaaaccacagtaaaagcaaatattagcacaagaggcatgcttaaaagttaaaacacaatttaaaagcaactctcaagtcttaattattgacaaaaacaaaatgagttcttaaacatcaaaaggcattttaagatgatcatggttacatcctatgacagcacaataatcgtgaaaggactttatgaatttaacaaagaagatacattttatttgatcaataccttgatatctctacctacaggaccatacgtatatgaggcatatacaccagcctgtttccgcctgaaatgagaagctagagtataagtatctaaaatctaaatctgtatctgttgccattaaaatttattaatgggtgaatacgtatattagccagacacgtaaacatgccttctctctccaagaaaataatgaggttccacagccataggataatttaaaaaggcgatttctttcctttggaaaacaacccccggaatcaagcgaacgattcaattatatactagtatttcttaaaagaatataaatcaaatcacccaagctgtagaatacagatacgctcgacatgataatgcagcaaaagagattatccacccaccgtgggctaccttgaggttcatccaagaaatcaagaagcaacttttggttggttatttttccatgaaattctttccctgcatcatttaatccataatcgtgatcatcccatgtaccaataacctattaacataccaaatgtgaaagtcaggccaaaagaattgataagcatagtcgccattttagtactcagaaatttgaatgagaatatctactagggagcaaaaacaagtagaaaagctcagaacgaagcacctcagcattctgttggagtcgagcatagccaggatttgacttagctttttcatatttagccttcatttcctgctcagaggaaggaacaaatcgtggaacattcttccacggtccaacagtcctttcctgtccaaatattttgaaggggcgtttgaagtctccataaatgttatcacccagccatataaaaatttggggatggaagttaaccactgcatcccagatgggctggcaaagaaacaaaacactcagcatgcacatatataaatgacctgacatgaaaaagttaagaatatcctgcaagcatagcaatcaaaagcctaaataataacaattattgcacttgtgcaggggaagaggtttgtagcctaaagcagtcaaacaagaagccaatgtaagattgcaaacccaaactacaaccaaaaaaataccaaggcttaactcctctcttctagctctgtgattacgtgaatttagttgtagatgcaatacaatttagatggcttgattaagaaatactacaaaagaccatacagtaacgtacaatgtaaatcataaagttgtctagtttcagtaaaacatgaatgattttagtgataaaagtgtgaaacacactactccataatgaattttgatttcttctaaaaactgggggataaaacggaatttcacacgtatctcactcttgaacaaaaattatactatgcataattattcccaccaacaattcttacaaacagggaacatgttccataaaattaatcaaatttattttgtttgcagaaaattataccatttatccacaagacactttttttacagcattattgttgctggttttcttttaagttgagtacaacagaactgcagcttgcttaaagctgacgtaacattggcactgccacagcatgctagtacaagaattgggacatcatggttgaaacaaagaaacagaatcattagcatacaagttccattacacgacactgcaacatgggtaaaaataaataaaacaaagacaagacaaaacaaaacagaactagaataaaaagtagaaaaattaaaatagaaaaaaaaaagcataacaaaatagaaaattttttggaacctgaggagcgctctggtcggagcatgatccgaaggcaattcgagacaccacttgtttctgcttctggtgactgtcggaaccggtaacggttactactgtaacgccgaccattccaatcaaaacgacggcgttccaccaccgccgccgccaccgacgttgatcgatacccatttgcgcaaaaatcacaacttcgaatccaattctttcaaagagatcataaaaagggaactttcttaggatgtgagacaaatggcagacacaaaatgaaactttcggttgttatataatgcatttcttttctctttttttatacacttcccgataaaaaaaaaaaagaaaaaaaaagtgaagagaattcaatgaaacatttttcaaatctggaaataaatatacgtaatttttttaagacaaaaagcttcccttttttaattaaacaaaaagcttcctttttgctgcaagatatcgtcaaaagtcaatatttttctgtaaaaataatattagtttggaaattaagtttttttaaagaaaaatataagtactataggaattttacaaactagaaagacaaaaacatttttttcttttattatattatagatgtaatatattttttaatttgattaatgattaatttttattgataaatatttattcgacaattaagctattttaataaaattttccttcttaaccaaatttttcttaattacaaaatttaatgttgagactttacttaaaaagtttaaaatttagttttagtcgaattaacataatcttaatcaaaataatcttaataatttatataatttttaacagtaaaatactattatctaaccatatgttattatttatcatatatattgcttataatatgtttattaatttttaaaataattattttaaaaatcatattttaagttatattttattgtttaaaattgtaatgtacataaaaattaaaatattcttaatttatgatttattaatatacttaaataataaattaagactaatatgtgtaaaagaattggattttaagtattttttaaataataatttatgtacattatttactcaactaattgaattaaatttcattgatatatttttaaaaagaaagataatgcacatacattatgatattaattattggcctcaaaagagaaaaggaaaaaaaattaaaaatatataaatatgagaaatgataataatgtgataaaaaaaatgatgttagtaaagtatttataatattgaggtttacccattggaaaaacagaatccatgaagcaaacaaatagcaatctaataaggcaattcattcatacacatttgacaaagcttttactaccatgaccagtgtccacagtgaagcaactttatgagccgcactgattgataaatgttggaatttgtgttgactgtagttgaccactgaccaaacctggaacccatttatccaatgtcctccaaaagcatacctcaaaggcgagaaatctggacattatgcaatgaaacaaatccaatgttatcattttcaacagttaccagacagaattgcatatttctaccctctctttaatggccagagcctccataattgagggtatcttttgttcatttacttttttattgattgagagaagcaactgttcatctagtttgtttgcttgtattatatgttgtgactgagtggagttttggatagatttggattttatttgtcatgagttgggcaagaacagatagataacttggattagaggaagaggaagggccacgtgaaattttttccccccctaatgattttgtacgtaaaaggcacgtgaatttatatttaaaatagtaaaatagatagttaattctttatggtttatacatcaataataattttgaatacgatgtaccttgtttaaataattattcaatcattcgttcgtgcattttctattcaacatgaaacatcttttactgtactttgatattatcaatttttatacatattcgtttaagaggcacaaaattttggcaatgcttgtcaaccatgattctcctcgctatcaaataccaaaaccaaggaaattcacttaatgcacttctcatatttgctaattgtacttcctttattttctgaaaactaaattctgaaaagtggctagcattttaagacttcctaaaattaattttcagaaactactttctaaaaatgttataatattttctggaatttacttttcgaaagcaaaattaggagtagttttataaatttgtcaagagagacccaaagtaggacttcctaaacaccactgtctctcaaagctcctaaattgtaaggaataggttgacattaggggacgtgctttgtgaaagtggagaggacaaactcaaagacaacaatgttagagacttcatttgtttctctcttgatagatccatacaactcccatttttacttctgaaaaatagtttttgaaagtattattacactttttgaaaactacttgtttaaagcaaagataggggtgcaattttagcataagtgttaaaaattttaacactttccacaacttagtttccaaacaagaggtaactttgagggaaataaaatagaaattacctaatgggaagtgcatttataacaagagagttacatttagcaattgtccaaagaagatgaaaaaaacatactcacaaatttatttatttttaaactaaactttgtatagttttgatttctaaaaacgtaatacactatcttgttaatatttaaaaattaagaaaattctatataaataagacattgaaaattttaattattccaactaaattgcttactattaatttggtccctaaatacatattaatattatctcttaagttatatatgtgtgtgtgaattaacgtgattgatggattgcactctggtgttatttagaattttttttaattttaaaaattaatatggcgttacatatttttagggactaaaatggtgatatattttttattttattataagacaaaaatatattagatggtggagtacaaggagtaccgttgcccattattatatccttgtatgttcaagtagtagcataaaatgggttagaccaccacgacagatacattttccatatcattgctttaattcataacaaacttttcacctttatcattttttcaccacttcatctgtgttcagttgatcgataagaactaaagtatatttggtttctatgcacccgcattgaccatataatacaaattcaaatgaatttctagaaccttatctcctccctcctatttgccttccctaaatgtgaccaatatagtgttttacctaaacattgtaatgggatgtgtatgcacctagtcacatgtagctcttttgccaaatggttgtataaaataatacaagagaaaaacaaaatagtttgttgattctatgttacttatgcaaaagatacactgaagttgatctctttggtctataatacctcttctaagtatatatattggacttttggtggaattttaaccatgtaaattccttgactttttgaggggacatacagcaccatagattgttgtatagttttctatttgggtgacatttatgactttggatttaacttaattgtaggctgatttcacttaatacttacttgttttccagtaacatagtgtttgtttatcatacagcgttcagaggggcatctcgtattacaggttccggggagtgaagttccatcgtggtttgaaaacagaagtttttcttttgacgaggacacgagaaatcactatggtttcgattcagctgtatcaatagtaacaaacatccctgattcttggcgttccactgcatggtcaagaattgccatgtgacatgtgtgttgttttagaaggttaggtgtcgcaatatttgtgggaacgtagcattttattggtcttctaaaaagatcgaatggggtaaacatgggaggaattttacactaacaaccatataagtgaattagacaccacactttaacccaaaaccttaaggttcagatttatggatcttctcctcacttatatagtattcaacttttttatttctatccgatgtgggactttaactcacacttgtattccaacacaaggttgggtagatcgccctcaactattcattaggttcttaccctttaatcgtgattactgttggcaacatgtgaaaggtgaaaagaaccaacttcacttgttgctggctactgaaactcttcctcgtagtggtgttgaacattctcatcaaggaccaaaacctcgtaagcttgaaataaaaaagtgtgggtggcgtgcattgtgcaaggaagatgttgaagagtactggcgcttaattatcagcaacaaccagagaagaatattgcagcagtggcagtaataacaccgacattggtcctctgaagatttcatgcgtttccacgaagttaagagatgcagtgaggtgtttgaagcagaagctaaattaacgcctttcataaagaagtaaaagaagaagttagagatcacctgcatgacccagaaaactcttatctttttttgaccaacatgtgttatatatcatgcaattttacttcattagaattgctttttaaggaaagatactctaccaaaatttgggtcccttttatagacttttgtatccgtctttcttttatctgtttttattcatttttattttattttgtattgttattatgatttggactagcatagccccaaatttgttgtttctctcttcttcaacaataaattaaaggctaaaacttttcgattggaatttctgaaatgcaagaagcaacatccataataaaattgtttgagcccatttcaaaaaataacaaataaacaagcagaaaaaaatatccaaaatggaccacatagtccaattgcgataaaaaaaaatccaaaatggaccacatagtccaattgcgataaaaaaaatagagaaaatacaaaaaatacaaatgaaatgaaaaatgaaaaacaagccaactagaagaagctctttctcaagacaaattccatccaagtatactatatatcaatagacagaataaattcttccagtggttttacaatactgtcttaccaaataccaactattgctcctaatgcagattccttttccctcatcctgctatgagcccccatatttccatggagttttcgttgtcatcattaaacagagaaagattattgaagcaaaagcatctgcttttttaaaaacaagtcttccaaaaataacatatgcactaatgcaagacgtacatattagaggaagaggaaggcaaacataatctttgtattttttggatgtatttcatttcaattgtatcattttgtatctgacttatttaattatatgagtatgttgacttatttttattggtctaacgttttcgtccctatttttcaatttatcaaattatttaattattaggcttaattatactttttacttccaactttttaacttctaaagaattttattctaacaaattaatataacatattttattccaaacttttaagaaacttgcaaattgtatcatatatcaatttattcctaacataaattgcactttttgtctccaatttatttgtactttttgacaaattttacactcatttttttttgtgtgaattttatctctaaattttttatttcttcacaaatttttctccgaacttttgtgtttattagtagacaaataacagggaataaaatttgtaaaattattaaaagttagggataaaataggtcaaattaatttattagagtaaaattcacaaaaaatttaaaaattgagggtaaaaaataaaattaagcccaattattaaaataaaaatcaaacacataataaaaaattaactatattatggaaactagcttttatgaaggatatgttttaaagaaaaaaaaaaaaacaaacaaacaaactggcaggaatgcaaaaagtaaaaaggaggaatgtaaacaacatagcccaaatgaaaatgtgtcatccaaacccatttcatacttacctaactgaatattgcttttggattacggtccatcttcctaattggcaacatttatttgttcaatggaatgtaatcatccaaaaaaagagaaatcatcaaatcaagctgatatcatcaatccgaatggatagatatatttgtttatattgagtacatttgaggcccaaaaatctcagccaaaccacaaatcactcatcaatgaggagaaaaaagtgattgaaaagttggcttttgacttatgagaaacatatactgttttaattcactgtattatttaaaggaggcaaccaaaactgaattacaatcatgtttttggttttctatatgcaagaactttgcaaaaacaccaactaatggtgcagtattatatgtgcatgcctcagtctgcataaaattgttccttcgatcctcaaaattgtctttcccatcaggccctccaaccaaagccccaaccagaacattaggattaggtgcctggctaccataccaattatcatacccttgagtacaccctatgaaccctttattctttttgtatgacacaatggatgcccctctatggtgcacccttttagggtagttagggccatacccaactaaatagctcatgttcattgggttggaccccaaaatgtagtcaacctgtgactttgcaaaattaagaatttcttcatggtccactgtgccgccatggcaatttagcttttgatttgtgttttgaaggaaatcagagtatattgagagcagaaatgctgctgttgaaacgtattgcatgttgttccattgccggacatagattaatccagctggggttcgtttcacgttattgctatcattatttttgttgagacctgagcaaatatagtactctgccttcgatttgtattgttcaagtatatccctatgcttcttgtgtttttcttcgcttaagaactgcaaaaacagatgaaactgtagttagattacatatacttgctgcatatgaaggcactgatacttcaatttgtttcacgtatccgtattcaatacatatccgatatgatattcttcgatatactttgtatcgagacctatgtagaactgagaattcaatttgattcacatattctatactgatacatttttggatacttaacttgatacatgatgtattcaagttttctaaaaattcaatacagttatttggtttctaaaaatttattttaaaataaatatggatgattttttgaatcgtcatacgtcatcacttaattaacatctaaaacaaaaattttaaaatatcatgaaatagatgcaaaaaaattttttatcggagatcaaacataaaattcgaatatatatatcaaaaataaaaaatatatttaaacttgttaaataaacaaaaaaggtaatttgcatatttataattttaaaactttttcaaactataatcgtaaacattccaaataaaattaaaataaaataaagacttatttggtatgattataagttgataaatgctaggaatatacatccattgatgaattaaaaaaataactcatatgggcataaagagaaagaggtatattgggctaatgacttacgacaaataaaaaacttaggcattaacttcctacaccagacaaaattcttatacacccagcactaaagtgtgaaatggcggaaatagccttgctaaaataggtttaattgagagtttgaaaaaatttcccatacaccattctgaggcgctctgagaaattgtgaagccgtgcatttggggttgaagtcgccatcgctgccgtaggagtttgcatacaccgtcgtcggaattaaaggttgcgccgccgtcctgcagtgcttcgtggttgcgcgacagaggtaagtccattgcctgtatggatttgtaatccgtaagcattgtaggaatccgtagggcatatttgtaatccgtaagcattgtaggaatccgtagggcatatggatttgcaatccgtaaagaggattggcaacggtgaagagcaaacggatcaccaatccgtgaagtacatacagatcagcaatccgtaaggtccatacggattggcaatccgtatggaccttacggattgccaatccgtatggaccttacggattggctatgagccttacggattgtcaatccgtatggaccttacggattgccaatccgtatagaccttacggattggctatgagccttacggattgtcaatccgtacgagtgtttccagctacagtaacaacgcccgaacttacctccgatgacgattccggccaacgaaacctccacgactgctaacaacgacctccacaccaaaccaacaagccaacaaccaccaagaatccaagctagaaccaagaacaggagtgagaaggaagaagacgctggtgtatgtgaaaaaaacaaagcaaaacggacaaggacaatattggcattttgacaaaagtgttgggtgtataagaattttatctgatgtaggaagttaatgccaaaaacttaataatacgaagcctaattaagtttgtccaaaagtcttctaacatagaaacctgcacagtctgacttccgtcacacattttttacccaaataaaataagataaaaaacatccgttacacattaaatattttgaagggcagttttaatatgaacaacccccaaaaaaagtgcgtcaaaagtatcgtatgtaaactttgggtttaatctaaccaaaataaaaactttggactttttttaaatgaacttagatccttctaaaactcacaaattccatccctcaactttttttctttttatgaatttgatatgtagtattagatcatctattttttttttcatgaaaagttcatctattaacttaacattaatattttaacagaaacgctgacgtgacattttaatgcaatacacatatgtaagactcactacaaaatatatgagtctcattctccatggtctcattctcaaaataatgaaactcacatgattttcaaccaataagaaaaatgggtggaaaaaatattaccaaaaaaatattactgacactccttaaaagtatataaaatttaatttttcaatattataaatgtgaaacactttaacattctatctttttttcttccatttttaacatatgattaattcctaacaaaatgcatagtgacctaaattagtttctaaaaatgttagccgacgaaaggctgccctacctcataacttatttgctaatatttgttaaaagggaaaaaaaaagagggagggagagtgtactgaggtgtttaaactctcttatttcaggtctctaacattcgcctcaaccataagccatatcactttgattgcgctgtgttgcaaagctaaagcactaactgcacatggccttgtgcttggatacactttttaattctcatatctttaatacccctagataataatactagtatattaatataccttaattcgtgcatactccatgaatgacctttaaaataaagtaccaagatttaacccaccatcattttcaggttagaaaagcaaaatctagataaagttggatagatattaaagagccactcacatgggagaagaaaaaaaatcaaaggagattgaaacaatgaaacccaaataaaatgaaaacacactaaaggatcctatatttgattgaggcttgagctctttgaaggccattattaggaacaaaatgttattagcataagagagtgtagtaagtggaaaaggatgaagaaagaagaaaaacggaagataagaaagattgtagatttgaattttttaaactgatatttttaataaaataataatattcattggaaaaaaatgaagaaaaaagtttaccttagaaaccatgagttgaagaccagcatacttaacgtcccagctgaattctgaaatggaccaaccagtgccaccaaaggtatgcgcattggaaataacgtactcaagatacattttgttgtcggtggccttgtacagccacgtggcagcccacaacaactcatccatgtatccactcaccgacgcatagtagctctttaccactcccacactagcatcataatttcccctatacttgtccccgaactcaaacaactacaaaaacacacaataaatgtttttcatttcaacaatacttcttcaaaaatgctaataaatgtcctaaagacaaaacaccattaaagaagaagaaaataaacattaggaagtgtaatagtccattcaattgtgatctctaatagtgtaatcttaaatttaaattttttctatttattagtttcttaatcaatatcttaacaaagcctattaattagccttaatttctcatatacttttcaaataaaatctcagtcagcccaattattagttttgaaattgagattgtcacacaaaagttgctactacagacaattactattaatcatgcagcttgtcaaagccaataaaaaaagcacaatcaatcatacttttaattaggacacaaagcattggctaatgactcacctgcagggcatggtgtagaagcaagtgagagtaatgtgggttggttttcctgaacacaacggaagcagctgccatggctgctgcagtctctccggccagatctgaaccaggattgttctcatctaacttaaatgctcgccgtgaagttgtcatgtcctctgggcgttgccaacaataatggtcagtgtcaccatcacccacctgggaaaaaaaaaaaaaaaaagtatctcattaattttagaattccattcaatatcttcaaccaatgcctctaagtaattaaaacagtgagaataatgaattggattgattgaattagaaaatttctatggtagcctgagaatctaagtttttggtactcttaattttttaattcaatattaatagtggaaagaatttggacacattgagaaaggccttctcgagaacaccaccaattaaaactcttgaaatttcttgtagttagtgtacctcagcccataggacatttgggctagtgtgagctttgatgaaataatcagtgccccatttgattgcctccaatgcgtgttctagttcacctgcatcttcaatttgttgcctatactctatggcactccatgagagcatggtgatggtgaatgccattggtaaaccgaatttcacatgatcccctgcatcataataccctcccaccaagtccacctacacaaaccaaaaagaaagaaaaaaagttttgattttgaaagggaattggcatgccaagagagtaaaagacaagaatttgatgagttgggtcatgtgggtattttgagaatttggacctaccccttcttctaggccatcagtgaggccagaatggtcacgccaagtgacacgctgattatagggtatcctcccagaacgttgtgcttcaaagtagagaagactctttgaaagggcatcagcataatcaaaagcttgggtggtggtggtagtgaagaaggtgaagatgaagaagataataaaacaacaatgttgtactagcatgggcatgttggaggttccaaaatggtgtttcttatgtggttccattgccccccttccctcctaaaaaactttttaggagtgaagggaaattggaaggaaaaaaaaaaaaaaagtgaagtctcaccacaccaccacaagtgaagggtttgaattgtcttttaaaagcctgagatgtgcctacgatgtatctaaaataggcagggatcattttgggggagagccccacaaaatgagaacgtgaaactcacaccaccacttttatttgttttcttgcacacaagggtgaattttgcatcacttggatgtccatctgtgtggcaaataaggaaaacaccctgctatgttgactcttgttaaaattccactgtgatttcaaggcacctattctctccatttattacaagaaccgttttttacttgtgacttgttgcaggaaccttgcatgtgtagcttgcaactcttttcatcagtttcaaatcagttacaacaacagcagtaataataataataataataataataataataataataataataataatataattaaaagatgatgctattaagtcaaaagattaatttctcttatttaatagtttctattaaatgattttaattgtttaattaaagaaatattacatacttcttttatataataaatattgtgttttatgtactctcaataaaaaaaccatttcatgtgtaacttttaaaatattcataataaaaattaacaaatttattatatttaataatttattaatagatgatagtgtaaaaaaaattattatcactacatgctaaataaattcataaaattttagcattttttaactaatatattctcagaagttttattattcaatctttaataacggggtaaaagtgttcaaggtacaggtcaaaagcattcaacacacttattaaatatattatattacttataaatactacacgttatttgcgtttttaatatattaaatgtaaaatgtatttatttaatatttctacaaaacaaattcaaagacatgaataaaaaaattattttgattattcaatgttgtaattaatggcattaatggatgcatctctaataataataaatgaattattcaattctctttgttttattttgtcatgataaatcgaatttacacaaacctgtcgttactgtaccaactccaaagagtttgaattgtttaagtctctacgacttgctttcggtagaagattattttcagaaaataaaaaaaaaattaaaaaaatccttaaattcttaaaaaaattaaaagtgcaattaacttttaaaataaaattgaacaatatccgttgagaggatccatctctctcacctgatcacacatctttaatgggaattttagtgcctacaatatttttattttaaattaaaatttcttgtagaacaggtattatataactatctaaatggcatatttgtgttatgcatggctgtattttgcacagcatggaagttgtaaattagaaaactcgtaaactaattggagtcttggagaatcccaagctaaggaattcagggttgctaagtaggctccataaatgttgctttgtgcatgcagagggtggtctatttcttatctttgtaaatagtaaacacatgccaatgtgcacaaattttaagctgagcaaaaaatggttcttttatggctaaagttggtcaatttcttatatcaaaagcgatttgcctgctgtcataaagagaacgtttggcaggccttggttcaggcaaaaactagaagtttgaaaattattttggaagaagcaaggagggtatggtgcgcgtgcccataatgtgtgcgacgcaagtttcatccacatacaatatgttatttaatcattattaatatatgttggtcctctagctcttccctctttttttcttttgctcgatttttttatatatatgatcggcaaggtttcactaatgatatgataatgattataaccatgttagtttctgttatacactatgtttttacatgagtatgagtctatgagaactttgccccatctttttgtgcacctttatttcgtctgcaatacgatacaacaactaaggagagaggaacaaaatcacaaacaactttaactatagtctataacgatattgtagtaattattacaatcactaaaaaattaaccagttattttcttttggtttttcaatctacattataagaaaaatttgagagtaaattattaaatttgtctttgaaactgaggtgctaacgagttagtttttgaaagacaaaaattacaaaaaaatctctaaaattattttttctcaccaagttagtccttccattatttattgttagtaagtccatcaacagatgaatagttatatctatgttaatgttaaatcatcttatctctatttttttgtccttttttaaaattaccagtgcaagttttttaaaaaattgtatagctaaaaaattctacagggtagaacaaagaaaaagaggaaaatttcttgggttaaaagtgaagatgtgtataaaaaagagtgcaagggtggtcttaggattaaaaatctctcttggttcaatttaaaacttaattggaaaaaaaaggtggcaatttttggttgaaaaaaaaaggaatgtggcttgaagttctcaaagttgtatatgcatattaaattgcatatagttggatggtgactactttagatcaacttcattgtagtggaaggatattaatttgtttcactaggagttgttcgagtgtgggagaagattgatttttgaagtcatttgataaatggttattaggtaatgagtgattttatttacaagcaagattagataatgaggtgtctattcataaaaataaaaataaaaagataatgagttgtctatccaattcattagagagataaagggtatattttgatcagatttgaatgaaggagttattcccaagattgtttttggtgttagaatgtaagccattgtcttaaatatatgtctcttaaaaaactctcattaactcaattgattttagagtttatgaatttagttgttttaactttctatttttcttttacaaaataatttactgttttgaaatttcaaagtctattttttttccctcaaacactagtatactcttatgtcttatctaatactactcactgctagtaatgtaagtatcaaagataagatagtattaaataagaatattttagtaaaaaaatataacgatattttactttattaagtatgtcttaattttatgggcattaaccttaattaaacaactaaaaatatgagatggaggaagtaatttaaaataatacttaatgattttttcgttcctaaactatagacattttagcattttagtattattttaaaactattgatattttatgaatctaagattaaattttcaactttttttcaattatatatttttttacaattaatcatgcattaaatttttatcgctgtctaagataggcacatgtatccaagccgataacactaatcattcatcaataagaatgtccatctagcatatatagtctctagactctttactattgaaatattaattactaatggtggttttagtaacatgattaaataagaatactttaatcaaaaatatattctatcaattaatatttttttaatgaggatacactaactttcatcatctattaagagcatctttagtggtagatcttaaacaaagatcttgaactcaagatctgatctttacaagatcttccaataaaggaagttgagagatctccaacatggagaatggattcttgtacaagatctctcaagatctgcacattgttcaaaaaagaataaattttctctctctttctctttctctaatatctcaaaatgagatctaccattaaaaaaaaaaattagagagatcttgagagatctttaatactatgtggtattatagggtccactaaaaaataatccaaaatttcaatttaagatctaccactaaagatgctctactattatagtttgagaatggaagaacaaatatttttaacaacttaaattttcattaataaaaaaaataaagttaaatccaatgtattcccgcgtaatccgaaaggaaagataagaatgagcgcgcataaaatgtctaggaacaaacacaaagctcatgatgattcttaattacaccaatcaactcaggattaggggtaacagcacgagaaacataataattactctcgaattgataaaaagtaacataataattgaatttcaaaggtcattggccatgttcctgaaaataaaactagtaagtgaacagcattacccctggtgtacaaattaacagagtaagtgtcgaaagattttaatatggagaaaatctagatagagtcctgtaattcctccagatttaaatataaataaaattaatgaatatttatgttaattaagaaatttaattaatattattaaaatctattaattacatttaatttttaaaaaatcctttaatagaatttgatatcaagaataaaaaagagacactaaaatagaatctcaattaattgaaggatgtttttgagttgtattattaaataaaataaaagtagtgaaaatttgtttatatttgaataaaaaaataattattacttatatttaagttcagagatagtagctaattttcatattttactaatatttaacatgtgtattatacaaaataaatgtttgtttcatacaactaaaatttataatttataataagttaacatttttaaatatataaattatatcataattctaatattaataaataaatatttttaacatataaattatattttaaatttttgataaatagtttatgttgtgatatattattattttaattattgataattttttaaaaataaattcaaattagaattaaatatattgaaaatgatagattaaaagagataaaaattatgttaaaccattttgttgatattattaaaagcataagatgatgtgtcatataaatgtcataagcaaatatgtatatatatatatatatatatatatatatatatatttgaaattagcttttgatatttagttacagttgttaaacttagttgatattaaaaacctaaaaaaaatatcagatttattatataaggaaaataaaattcatcacttcataagataatattattcaaataagagtgaatgtgagagaaaatataaaatgcgaaagcatgagaaaacatattatcttacacacacatgtatatacaacacataagaaaatcttaaactcaatttctaaatgtaataagcatggttattttaattcttgaatttaatgaaaaagaattattgaatccatgtctttcatgttaattttctttatcataatattggtacaaaataagacccattaaaataattattaatttttattggagactgttgacacacacaaaataagtattattttctcaacattaaattattttgttgttgaaattgtatatcaccctttaaattatttcaaatattaactcattttgttgtttttagtgaagtgcattagttgtcaccttgggtgtgtttgattcgctaaaaaagaagggattagacaatacaaaaatatttgtttaatgtttgatttaaaaatgattgaaggacaatacaaaataaagaatgattaactggataaataacccaaaacttgtaactcattaaacctccatacaactttttgtctagtatctatcaaaagtaaaaatacaatattattatcattttctgactttttattatctcacaccttttttttcttttttcatatgcacccaattctctaaacatctctcttacaatacaaaattacttgtattatgcattgattaccaaacaacaacgtataatacaaaaagttatcttaaaaagttatcttgtgattcaactatttgtccaatattattatgtctgttttatctttttagtaaatcaaacgtaatgtgaaatatgacttttatgtcctagttagtaggaactaggattttgcatgcacctttatatattattgtgcctccattcaacgaattttcccatttggaacaacaaatcaattttaaaactcaccttgtaagcttttttaagatgacatttcgcttcccatccatcattatttctgatctcatatcttacttgaatcacccatattttaatgtgacatttttttatagaaacaatatagataagacattaaaatttaatttaatcttaatataaccattcaaataatatttaatattctaggtttaaaattcccatttatcatcatattttattttaccgcataagagtctcatgttatgtactctctctctatataataataataagaaactcatgaaaaatctcatctatctacatttaaacctgttccttgtactaacatttttcttgtctttccctttaccaaaaaaacacccaactaagctgaaagatttaacttcaccttgattaagacaggactgagttaaggaaattacatatatgatatattctttatacgatagttaattttgcttcttgacatgcaccgacaaaatatattccatgatgcaagatccctgtcattgttccttcgaatgttttgtttgcatcagcccattaaacatcacgtgtcgcatcacatatattgagtagaagaactgaagaaggcttacaaagaaaacgtgacaaattcagttttcttagaatcgtgtctttttttcttccccagatcatgacatgcaccggtctgttgattatttgacctaataaatcacgagtttaatttatacattttgttaatacaaaagaaattacactattaactagtctggaattcaggatagatgtaatttttctgataattattaaaaataaacaaatttactttattattaatttgtgattaaataactgtaaataaaatttatagttgtctgtatattaaatcattatattgtttttcttttttttttttacaggctggacaaatattttgtgtgtatgatgcacatagaaatgtaaccgattgccgtaagtatttcctgtatttataattctttatattatcattattttaattatttatatagaattactattgtgccactactaaagggatcccttatgaatttcgaaggccaagatttgacgttgctgatattaaagacgacgaccattcgcctccgccacgacaccaccacaaccaccatactctaccattatcaaacacaagtgttctaaccttcctccatcgttttattttaagaaaagaaaattgtgagttaaaacaagaaaacaaaataaaggttagaaaatggtgaagccaaggatagatatgctgagatcttttcactctgccacgcctccctcctctcttgccatggctacagcaccgagtcgtgatgtttctcggaaccaccggcgagatctgaaatccctctcatttcgagcctcgccctttacaaaatctttgagatgttgacacgacacctatgggaccctcgtgcttggacttgccgacgtgctacttctgcggtattaccaccaccgtgaacctaatctttaatggtctaggagccttactgggaacaaggggatgaacatgaaaaggagaaacacataatcacaaaaatagggtcgaacagattggtgtcattcaagaaaaatcctggtttttaaatatttaagagaaaaagtagaaataaaaaaacttttaactagctagaatctgagaaatggagtgaattattggagaaaaaacacctgattataaatgtaaaataaccaatattgcgaaaggaacctaaagttgaagaggtctattaacttaatatttttaattatttattacattctttatcttattatgtaacaaggaaaaaatctttatcttattatatatatttttttaaaataacacaaatacattttctcatttgttttcatacttaaattaatacaatttcttattaatgtattaaatagtgcaacatataaactacgtaaccataaataaacccttatataagctttcaccatggatcatgacaatattctttacgtaattatccccttatttctggtgacagctgttctgatacgacctacattctgttttggtcatctcaactacgtctaggtttcttgatatggagactttccactgaacaaataaattaacttactatagatttcggaccatctcaactacgtgtaaatggcgtaacttaagtcttaatatggagacttaatttacactgaataaataaattaagttactagagtttagtgcacgagacttgactgataacaagtcagttgcacacacattaccaagcatgataaaaattaaaatattaattgttttcttgtataataataagatactgattttttaacccacttcctctcctcctttcttttatgaaaaaccctatagggatgaggagtctacatcttctacaaaattaacctctttttcaaaaaaaaataatccaaatcgaataaacttttaatacacactttttttatacgttttttaatacacatgcacttgcaaacaaagaaaataaggaagatggactaaatttcttataaattaaagtcaattataaattttaatttttgaagaaaaaaaatagaccagagaatttctaaaaatattaaaacacataaattaattttttatttatataagtagtttaatttatttaatttttttatatccaggcttaagcattgaattgaaaatctgtacaataaaaaaaaaatgaattttgaaatctcagataagttttcttttttttggtaaacatatagttttggaccacaaatacatgcatgttacgagatcatgttcgtagcctagaacttaattagaaatgtgctatggtactcgctcaccgactgttttatatcttcgaaaacagaaaacagttcatatttgtggatatcccaacccatttatatataattaaataaatacagtgtcttgctcttacatgtgaaccaattaagggtgaagttggccagcccctcattgtcaccttatagagcagagactaagtcttcgtaatttcaaaatcaagtgtactttagcttctagttagaaacccaaaataggtagggattctttggttattaacaacagaagaatgaaagtttatacatcaaattaggccttcattaattcactgtgtttataaagtggcggtgacgaacttggtttggttcataattggtccacacgttaagaccctgcctttaaatgggttggtatatttaaaaaataattgcggggcagacccaactttgtgaagagcttggggagatactatatatatatatatatatatatatatatatatatatatatatatatcagtcggtgcatttcgtagcacaatttttaagttctaactcaatgtgtatgtgtaggccaatgcaaccctatcatcacatgtacaagtggtccaaatcgagatctttggaaaataggaaacttcatggctgaaattcgatattttttagtttacagatttcaaaatccaaattttaataattgtggagaaaattccagaaggtatacacttaaacattatacagtttccaatgagaagaaaaaagattgcttttgtcatggattttgtgtgcttgtattgtgtgagtaatcaatttttaagactcaggagtatcttattactaagagttcagtgtctaaactgcatgagcttgtacctctacacagctttagcagttttttaacactaaatgataatcaaatatacaatgaaaaattgatctcttttatttctaagaagtttttcttcttaacttgtaattggaatagagtctcgggaacttaggggttagggcatctctaatggagaaattaatgagtttctctactaaatgttttataatattttatattttttataatatcacaccacaccacattttttattctaagtaacttagtcaactttttactctaactaagaaattaatttattaaagtttctcaaatcaatcccacaataaaataaaattaatattacaatgatacatttaaagcaagcctcacaatttggagaagaggatctgttcctatgcaaagcaaatccaatcttaagcgaattccactcaacgtctctccaacgaatttcacaacattatatctctatttctcacctctatacctatattcataatcttatattaacttcagcattagtgtttttacatatatgacatccatgccttggtgacaacaatatatgaacacttgttagaggactatagcattcatcaaagtcatgattatgtacaagagtccgtgctcccttatactcttctttcccctgtaccatgcattttgtttctcttgaaacaagatgaaggaaaattaacttcaaaacaaaaaaaaaaaatcacatgtccttttcttggtttagttatcaattaatttataagtcatcttacaaaatttaaatgtaaaattattaaaaatattatttttataataaaaatattaaacttactttaaaaagtggttttgattaaaaaaaatgattaaagtaatgtgtatatttttacttttttttttgtcaatagtgtatgttcttacctttacgtctatcatttcttattttttatttacaactaactgcatgtattacattattaggtaccgctcaaaataagtataatggctgacaagaaattctaaagattaaatatttttacagacatcacacgcttaaataaatagcatatttaatttggtttattttaaaagattatcactttttacacctctttaaaagactttttgctaatagaaaataataattttttaatttttattaagtcgaaacatacatgagttgaacttactcacttattaaagatattggatctaaagtccttaataggttattcaaagacatactaattaactaggtatttaattagaccaaataatcaacaaatactaacatgtaaagaattattgacaataataagtagataaagtaaactatatgacatgaatttaacaaatgatttatacaagttggcgatagaaaaacactaacattatactaaggataaaatattttaagttggataaaaatatcaaactaatacttatttaagccaacttactcaaagtacaaatacaaatcacatgtcaaatgaaaaatactggagagaaataacagttatcacttctatatagttgttataattaataactagttattgacctaattagaatatttacaaaatataacaagtttatgggattgaaataataacaaaaaaatgttaacattatctctatttttcatatctattaattatctattgtattgaacaccaaacgtgtgaatcatcaattgacattaaattatattaacataatcaatgatttcaagtttaaacctgaatatacaactatatcaatatttaaaaggaaaaattttattattcataatagtcctatcgatttaaataagattgtttattgtgaaaatatgatttatacaaaaatattatattgtcaagagccacatcactaaaataattgttattattattataatgaaaataataaatatacaaattacattaaaaatattgtatacaacaaaatgtttaacagattacttcaatgaattacaatatttaataagtatatttcatttttttcaatcctaaatttattcaaaattgtaaattaatattatctatcttttaaaataaacatatttttaaaaaaatatttataatgaaatataaacatataaaaaatttattattttgaagaatatgaaacagaaagattacagaagagaaccggggtcaactatcaagactccttttttttttttttatattttggacccataacggttttttattgtccatacatcttttgttttcaatccagacagagtattgtatacaacaaggccgagttttgtataaaacttgggccaactcaactgaatatagacaactacctaatacaccccaatttttccgtgacgcacctccaaaaattttaatatgcctttctaaccttcttcttcctttctcaaccacctcctgcctgaaccttcaccgactcaccatcactcttgcacccatgcaaccaaatacaacaccaccatcaccaaatctaataaaagtatttttttttggtaaaaatgcacaaatataagtataagatagtatgttgaataaataatacgaatttaatacatatttttctatcttatgtgcataagttcaaaaaaattaaataaatactcttcaatatttttaattacataaagataaatattaaatgttttcagccaaaatttctaattatatttccttaacttatatacttgatttataagataaaaaaatgttattacactttgtctatgttgaataaataaatatgaatttaatacatatttttctatcttatgtgcataagttcaaaagcattaaatacacattcttcaatacttttaattacataaagatcaatattaaatatttttcagcaaaaatttctcattatattttcttaacttatatacttgataaataagataaaaaaaattgttaatacactttgtctacagtctatgcaaaaaaaaaaaaaaaattgttaaaaactaacatgagttaaatctagaaaaaaggattagtctctcacacgtaatgaacaatgtttgaattcccattggaagagattctcacaattattgtctgaccatatctctcatttacaaaaaaaaaaaacagttaagttttatttataaatgaaatttaatgaccatcttataaaattccatgttgaagtatgatataaaatattgatttcaaaataaataatgattaatttttattaattatataataaatattactagtccccttacaccttaggaattcatatctacttataaatatttttttttcattacaaacatgtatttatcttaattttaattgaaattttataataacatattctttattaaatttaagaacatataatttaatatactttatatttttactctataaaaaactaataacatttttttttgtgtgtatgtaaaagttgagctttaataattttatcccggtgtcactttgaaaacgtatatgaataaacatgcatgtattggattgaattattttatccttaagttcaacattaacaatgaagttgtaagacaacacaaagaaaatattcataaattataatgtgtatttttctttgtgtattaaaaatattctttagtcgatgaaaaaaataattattttagatttagagattaatgaaatgaatttatttttgccaacatttttttccaaatataaatcaccgtataaatttgaatgagtatttgtaatcttaattataaaaattaatataattagctttaaatttaaaatgatttttttaattttaatttaaaaaaacgttattatgaaatttaatatacttttcttaactcaaaataaaaactatacgagttccttttgttagaatagcctttaaatgcttttcaaaacactcactaagcactttttcaaacataagaaaaaaattaaataacaagatataatataataaataaataattgagttttttaagcatattatcaaaaattcgattattagtcatgtgtatgaagaaaaatttgttgacaaaaataaaatatacttcaataatttctacatttcttgtcaaaaaaataatctacgcatttcaaaaataattactcttcaactatcagttagaaaatatctttaacgaaggaaaaataaaattaataaatatgattaaatactctaattaaatgggtatttgaaggttcttggtcagagaaccaaataagttaatataatttctcgtatgtttatttaagatgtaagtgagacaaattaatggaagaatttgacttttgaatatatttttaaaagcaaaatatacttttggccaaatttaagtttaatgttttaatttgtttggatgatttttttaaaattaatttatatatattcttagtacaaatttgtgacttgaatataattttagtttcttaatttatattaaatttatttttagtctctcatattcaaaattatttgtttttatccatatgatattgactcacaaaaaaaatattaaattttgtcgttaaagaaaacaaaaagaatattaagggattatttcacattataatcttaaaaaaaaatccaagataaaaagatgtatcatatttttttaaaattaaaataaccggttaaattatatgataatgagtcttacaaaatgtcaagtttcacaatatcttataatataatataagttaacttcttcaaaaaataaaatatgatagagtcatttataagtatttagttaagagtaagtgtcaactcactttcttgactcgtgttctaactatatctaaataaaataaataaattattgcgtcaatgtaaaatgatgtcccacacttattcaaggcatgctttacaagtatttgtttaaagagtgtccaacacactaactcatcaacacacattttttgctcaaagcatgtttgacaagtgtttgacacaacaacactttgactcataacacgtcattatgcttaacgcatgtttgacaagtgcttgacatgccaacaaatagacacaccgacacaccaacacgccaccattctgcttaaggcatgtttgacaagtgtttgacatgccgacacaagttctgcataggtttttataccttatagaatgtcgagtatatataaagaacaccttgagtttggaggtggagaaaatgttgaatatcatgagataatccaacttgatgtcggaaccaaatgagttaattgtgattaggagaagttcattgctttgggcatagtggaacattgatgttgaagggagccaccacatgagaaaatcagtataattttgggttggttgttcctggtaggtgtcataaaagataaccttacacctaatttttatatattcatgtgtaagatatctagttaaagaatttaggattaaatgcacaatggaggtcattctagctagaaagagaatgcataggggctaccttttatcatatctaccagcacaatcaacctaaaagtgtcatgcatcccttactcggtggcttgcttcaactcgatgttaatgctctactattcccacctaaggccacctccaaaacctactagtactaaacatttttacacgttatgtgaaaatttggcataacaagatcaaatgaaaatttaacatgaaaaaatccatgcctaagatacacacaaatttggcatgaagttccttgtattttaatcaatggtttgatttgctttaagtagttttgagttttcacttgtcgtgctctacttttgcagtgcaatttagactgtgtcgggattggtaatgtttccttctcattctccttgttggctcgttgtgaatgccttgtcttgcagctgaagtgtgaaactatcctaccattatttcaaaattatatattcaagctgggaacaagtatgatgattccttcattaattgttcatgccacgagaagaagtgatgtgtgcttaatttctgctcgtgtaaaacaaatcttgcttttgaaacacattttttatgaatatttacttgttactgactgtgatttggttggtcatataaccagggtgatatggcttggtaatacaaattctgctctttgtagctggaattaacacacttctccgaacacctttggaactaattgcctacaaaagttggaggttcatctgcatatatactcttccagttgcttatattatcactgactgcctacagaattatatatttccccattccatttgttcatcactggcaatctgagagcaactatgcattgttttcttagtttgtaacatctaataaatgattatgggaaacattaacgcaatgatagtcatttgtaagtttttttgttttatggattttatccgactttatttggactcattttatatataggggttagaatgtgtggatttgtatagtttttgatgaggttaggagctatggtgatcctcttaaaaaaaggagctatggttgattatagttatatcttgataggctgtattaaatatatggactatggtgtctgcctaatgcgttaataattctataattgaaccttcaccaaccttatcaagatgtgctaggatcttctaggttaaactttttttttataatcttattatgatgtttttaaaaaatataatggataaattatcaatatgacatcaccactcctctctaatttcaaaggtgaatttaaatttgaattttatttgcctttatgaatatataaattgatagatgcctaacaaagctatcaatatataattctttttcgatacattaaaatcaagacagaaagagtttatataataaaaacaagaaagaaacagaattttaatgatagagattttcaccagagagaattcaagtgaaaattttaattaaaaaaaaatattttcatgtacatggtgatttggatcccctcatgtctatttcagtctaagtttaatcaaaatcttaacccttaattaaaagttaacattaaaatcaataatgacgtttgattcagaataagtggtcctacatattaaggataaataaatttttagtcttttaatttatttttaaggtttagtctgattctctagtttattttaaattcaattaaatttctcaatttttaaaatttgttcagtttctgtctaaattaaattaatagtgttaagaaaatgctaacgtccttgattaagaaaaaaactaaataaactctttcgattcccattcttgtaaaggacagaatgaatttcgaattataaaagaatgcgtttggatttataaaaggtggaaaaaaaatatgaaacctaattctatctttatcgacttttatagggtttaggaacattttttgggatacccatctcaaactttttaaaaatttatttattcatacattttaaataattacagattaattattaattacattttaattcaaacaatatttataaaaattaataaagaatcaatattgtaagaatatttaagaattatattatatttttattctaatacaaaatttttagttttattatttaattagtattataattataatattatttagttaatcattaaaataattattctatattttaataatgataaaatattaaaataattacattaggaacagaaaaagaagctgcatcaggaagcagcaagaaagaaataaaaataggaggctctggaagagtcttaaacaaatacgagagggacaagacactgctagctaacttatcagcgacacttgaatcctttgaagtttgaacacatactggaacatgcaccccactgggagacgcaacagccttttgatttcttggacaatgataccaaaaaaattatatatatatatatatatatatatatattaatagaattacataatatatatgtgtatatatatatacacattaatagaattatatataaatgcataattatattattaataattacaaatatatgcatagtaggataagagtgacatactgagtcggataaaacccaaatccaattccgatcaaacaaattctcatggattgatgatgtttttattgccatgcccattttgaaatcctaagttgaaaatttaacgattccacgcatcagatgacgatggaaacagagttattcactcacagaaggtaccatttcgaccaaattattatgcatctcaatgggtgccgtacagtcccatcaggggaccatagtgacgcacagtgcttcgctggtttccccagtaaggacacttcaacttcatagtcgaatatcaatgacccctcttgggaatttgtgggccccccacactttcctattcaagtattcatacacggttattaagggctagtttcgtaaaccacgtcgaatttcaaaaccaaaaaataataactagcttatcgatcacaattgagggtgttatgttacacttccaccctcacttcactctccattatttgactaataaatatttatgcttttttttcactttataatttattgttgcactttactttgttgagaattcttcttcatcttcttcctcatcatcctttcctttttgttctttcgatacctctttgtttctcttcttctgaagctacaacaatggcagacattacccatctccctatggaacagcttcaggaccttgaatgctgcttagactctaatcctccttggggtatgctctctctccctaatttgtttttctctcttattataatctaagagttttttctattccttttcatcattttctgttgccatctgacgaaacaagggggctttttcttttataagcaaaaaaagggtgcttgttaaatatttggatttgaacttaatgatcattagggggtaaaattaaagaaagaggaagcttgcccgttttgtagtttctccaactttagttacgaacccatatggatgaaatgatagaaagcttttttctttttttgtcttgaagccattgcatgagctgggttttcttccatttggtttgttatttttgtacgcgttactccaaaagtttgagactaggctatattactttgtttctggttatatggattaaaaagttgagatttttatgctattttagatagagtgcgactttgaagcttgaacttttctgttttagtctttttctacttgtgttagtttttaatttaaacataaaatgtgtattataatttaaaacattctggttttttaaatagatatatagaatttctgtttctcatcatcattttaacatgtcctttagcgctgtgagatagtgatcactatttctaagaaggcttgcaatcatgagtcatgaccattatattgtaattaccactttaccctacttcttctggcctggttaatgaaaaaaaaattatacttattaatgacgttagattcagaataagtggtcctacatattaattatgagaatcaaccatttttaccttatgtgttgaagaaattgttgctacgaactacaaagcacctactctgattaaattttatgttaaaaaaaatctcggccttacatgttaaattcatgcactttttattcgtttcgttcgtaatagcgtgactctatagtctatacatatatcaacatgacaaaactttaaattaagaatgaataaaaacaaggttgttaagcctttcaattttcatatgataatgactcacaagaataatactaagggatcatttcgccgtgcaatctttacaaaaaaaaaaaaaaaaaaccaagataagaaattcttaaaagttaaaataacaagttaagttctatggtaatggggaggaggtataaatttggtttagtggtgaacggagaaagaaatgggggtaaaggtgatggtaccgagcaatcacacaacaatcgagtaaacaaaaaaagagaaagggaagaaaaataacacaaaatgtttatcctggttcacccaatgtgggctacatccagttattctctatatttttttcacacactcgctacaatgcactcagattataaggaaatatataggcttagaaaccctaagcacaatatcttttatgatatctagcagaacgattgacctgaaattatcatgcattccttactatgtgacttgctttagtgcgaagctaatgctctaatattcccacctaaggccgcctctagaacctcctagtactcaaacattttttcgttttgtaaaaatttggcataacaaggtcaaatgaaaatttaacataaaagaacatatgcccaagatacacacaaatttggcataaagttcttggtttcttgtattctaaccaatggtttgatttgctcttaagtaattttgagttttcagttgttgtgatctactttagcagtgcaatttagactgtgaggtgggatattaatgtttccactttacattctctttcttattggctcattgtgaataccttgtcttgcagctgaagctatcctactagcatttcaaaattatatattgatgctgggaacgagtgtgatgattccgtcatggattgttcatgccatgggaggaagtgatgtatgctgaatttctgcttgtttgtaaaacaattgttgcctttgccacacatttattgcttatatttacttgttggtgttttggttctgatataaccagggtgacaaggcacgggtaatacagactctgctttttgtagctggcattaacacacttctccaaacgctttttggaaccagattgcctacagtcgttggaggaggttcatctgcgtatatatatccaattgcttatatcatcactgacttgcaacaaattagtgactctcatgaagtaagtttcctcattccgtttcttcatcaccagtagtttgagagcacattaaactatacattgtttttttgatttgtaacacatttaataaccatttgcaatgataatcctttgtcctccgttgattttggaaccttgcatacctatatgtaactataagcactgaatcctctatgggagcttttagactcgcaacaatcctaaacatataaccaaggatttattattctggacaaaattcaatgattgttcttgagtgaaacacactgggattttagttgtagatatgctaattattgatcaccaggaaaatcaatatttagtttttaccaactttgctctatccatagtatgaggttgtcagtgaagtttaaaatgagaatccactggttttctgtcaaatggtaataggttagccccagattataaaattcaaatttagtgtaaagaaaaatgctagcggcataccttttgacatgctctttctagcacactatattattgtttgaaatttattggaattcatgaaatcttatggatcctatgccttattcaatgagttatgagtctcacatgattttgtgtgtctcagtaaatttcaaccaataatagtatgttctacttactagcattcctcatagcatataatacttttgctatcatttacgatttaaacttctgctgaatatttggactttgttttggatcgatgacatataatttggggattgataggagatcaataataaaaagggtgtacaccagttgaaacaggcagcacagaggattttgccatctttaattgaatgtatttcattggtcagtattggttaggacttaggagcagttagaatgcgagggggaggttaaataggagtaggagggaaagaatgaggttggaatgaaattaaggttggaacaggggagaacatttggctatctcgataccctgtggactaatacgttgtatttcatgttcttctatatcacattgatcagagtaaaagcctactgaataatacatcctactgttctttgttgatcactatattttcctctgtactgatttggttcttatctgttggtgtcaaagctttccaccatgtctctcagctgcaaacaagcgactcaggtagtgacatcagcattgcagtgttgttctaggactagtacactgccatcccgaatgggttctgtggagcgtggtgggatgttatgatccaattgaaagatatgggacttgagtcccacattggaattatggaattttattaggaggtttataaggcctcaggctctctaattacaattactagcttttgttgtgtgattctcataaggttcttattagggagcaacataagttatataaactttcttagaaacacagttagatttctttcttatttttggtttaagagatctttccatgtgattggtttgcagagatttatacaaacaatgcgagcaatacaaggagctttgattgtagcatcaagtattcagataatcttgggttacagccaggtctggggactcttttcaaggtatactagtatcatgtcacgtgtttatgagttgacaatttttaattaaaattttgaagcatttttgttttgtggatcttctatccagatttttcagtccccttggtatggcacctgtagttggattggttggattaggattatttcaacgtggattccctgtggtaggtgtggctcaaatctccatcttaattttcatgatctcaactaaaattgtgacgaaatggtctctctattgacagcaatttattctgaatgatgataaataataatatttaaggaacttatcttgaatcctatctccgagttgtcgcctatttaagtgaatccaattttcattgctgaaatttgatccttgttttcattatatatggattgagggttgtgtctacttttcatcttatgaattatttggtagcggcatatgcttaatttgtatacagatattggtgacattttctgtagaaaaatcctttcattcaacatgctaactatatttctgaattatttgatagtggcataatgcttaagttgcatgcaaatattgatggcattttcttcttcagaatcttgtaattgaccatgctcactatagcttgatggatgccatacatttcataacatcataaatttactcaatgttctttattattttcattttcagttgggggactgtgtagaaattggtataccaatgctgttgttggtaattggtttgtcacaagtaagtgctctaactagaaaattgtggtttgcatcaaattataattctttccctaaggcaaacaattttgctataaattgcagtatctaaagcacgtgagaccatttagagatatccctatatttgaacgttttccagtgttgatttgtgtcccatttgtttggatctatgctgttatcttgaccgccagtggagcttaccgacacaagcctgacataacacaacatagctgtagaacagacagagcaaatctgatatcaactgccccatggtacctgaaaaaacctgttctaatttcttctgataggttcaaaggttttgcttatttctgaggttttttcttcttgtactaggttcatgttcccatatcctttccaatggggtccacctacattttctgttggccattcatttgccatgatgtcagcagttattgtctcaatggtggaggtatctattttctttcctgattttgtttttatttttctggttgacttcagtctcacctgcagagttagtgtttgtatgttctatcccagtacttgttagttgttactacagattcatattttaaaatttgaccaaggggtctcaggccccaaaaaatccacaatgactaaagaaacaaaatactgattacaatcaccataaattgtctcattgtagtttagtgaattttctatattgtcttgacatcttgaccatgcacttgtggcagtcaactggtgcatacatggcggcctctcggctagcaattgctactccacctcctgcatatgtattaagtcgaggcattggttggcaggttagttacaaggcacaagtcatttattattattgaattgcctagcttatgcctgtgtattaatttgaatagttttaagacttcaatcccgtgaccagtctttaaaagttaaaaatattgtagaggttgatatgattgagagatggaactgattgtttattttatccaggggattggcgtcttacttgatggtctttatggaacagcgattggttccactgtttctgtgtaagtctaactcttcattgagttttaactgcatcagcttcttgtgtatgatccatgtatctttctatagtagcttgatgagcatcatggttgtttattctagggaaaatgtgggactccttggactaacccgagttggaagtcgcagagttgttcagatttctgctggctttatgatattcttctctattttaggttggtagagacaaatcgaagatgagcctggattacaatagaagtaaaccagttcttcatcatgttattcatggaaattgttttactctatgataaattataaacgagaaaagatagttccacttacctgagttttttttgttttctttttctgtcatcatctgtaggaaaatttggagctgtgtttgcttctatacccttcccaatatttgctgcactatactgtattctctttggccttgtgggtatgtcatgtaatctgaactgagatttgattgcaatacattttctcttgttcatgtatttacaattacattcccttgttcaccagcttcaattggaatatcgtttcttcagttcacaaacatgaactccataagaaatcttattatcattggactcacacttttccttggaatatctgttcctcaatttttcaatcaatactggactccctcacgacgtggccttgttcatactaatgctggatgggtgagttgtacttttcctcagccatctatattatgctttatcaactaacgtgttaccatcatgttatttgtttttagacttctttcaagaaatttatactttcaaatttttgttttgatatgtaacctaacctgttctttatacttgtcaacatcaatagccttttagtagtttacttgctcttaatgcaaaattttcatctttgcagttcaatgcattcttaaataccttattctcatcacctccaacagtgggtttgatagtggcagtgtttcttgacaacactcttgaggtagaaaggtcaaagaaagatcgagggatgccatggtgggtgaagtttagaacattcaaaggagataatagaaatgaagaattctatactttgccattcaatctcaatagatttttcccacctacttgatcttaatgaagatgatcagggtaggtaagattttgttggagttgcacattccagcattcatgagttaggactaacaaaagctacttttctttaacactaccaaccaatttttttgtggaccgcatgtgaaatcttggtccaacagtggattctaatgcatttggtccatgatccctagatgcaataattgctacttgctaatgagtaatgagttctgttccaagattttcatgcctcaacaacaactgaatttagtgaatttactgtatagttttctttgtccttctgatttagcatctttttgtttacgtacgattcttgatatttcatttgcaaacattaatagaaagcagagcaggttttgcatttattagaggtaaaaaaggaaattgctgactgaaaggtgttacaagcccaaatcgaaaaataaaaaatgctgatgcctggctccgaggacagtctttattttgcaacaaaattactctctgaagttgagctggaataatatgaaatgatgactctgactgaagccttgaatgccaccacatgttatgaaacgattcctctgtctaaagcctagaatatttttttgctagacatattgtataggttgatagccttcaacatatatatatatatatatatatatatatatatatatttaaatgtagtctacttcccttctttaatttagaggagtgtgactgtgttattaaggggttcaagaaagttgaaggaaagaaaaggaaaagaaggaaagagtataataaatttagataatttttaggtggtttggtggcaaggttgcccaagggtatgataattaaagtttaagctttttcgccaaccaataaaattttgtttttttttattatcaattttttaaatcataaaaagttatatatgttaagaaaaaggtttgacaaataaatattttgttatttatcaattaccaaatggaggaggtattattttatgatttttttttctgttctttcgtctttcaatatttccaaggagtgtaaggatgaaatgaaatgagataaaatgaatacaaaaataaatatatgaaattatggtaaagagctcagtgccctgtttgtttcatggtttttagaactggttgttttagaaaagaaaaacatggttggtaaaaaatagtttttgaaaactgtttttaaaattattttagtttttaatgggtgacaccacaccattgtgattctcctgtcagagctcccttaagttcatgttctcattcatggtcatctccacatttgcaccaccactccgatcatcatggtcaatcccttctacattgccacaaaaatctccaagcatctcaatgcttccaaggctaaagtcgtcaccacctactccatccatttccacaagctcaaattcgtgcaaacaaaatttctattaaggtttcgtttacagtgtgtttgatttacaagatagaaataaaagatttttttttttttttaaattaaagtgtagaagattcgagactcacataatttcttttctatttcacttctttttttcctcaaccaaacacatccgtagaattttcaaaatcaaatatatttttttatatttagattttgaaaactaaaagtaatttttaaaaatagaaatcaatcccatccaaaatatctcaagttattttggatttttattttgagtttcaagttattcatgttctttcttgtactttaacatattccttcacttgtcactaaaaattagtttttaaaatctataaaacaaaaacacaatcaaacaccttaaataaaattggatttatatttcatttcatcttaaaatactgtataaaattaatttgtttcattttgaatatccaaacaatcaaaattaatgtcattatgtctcttttcatcatagaggctatgaaacccatcttaaatgttgtactcttgatggtacgcttcatataatgtaccaattctcattgaattaagcattggtaggtagataccaacaatttttccactgctttggcctaatacctacacaatccaacttaccaatatatatatatatatatatatatatatatatatatatatatatatggaacgtgactcaattcaagatcacaaacaacctaactaattaactcaaattgatttaaattatacttgttttatatttatttatttatacaaaaataaaaataatatggaactaatgaaaagaaatcaattatatgaacttattaatataaaatatattatttaatatatatatatatatatatatatatatatatatatatatatatatatatacatgcattaatgcatgtctgtgtgttttttaatgcatttttatgaatcaagtttaacgaactaattatgaaatcgaatcttgaattatatttaagttggttccgttcgttgcaaatttgcaatcctatgtaaaaccaatgttctcataaatgcgtttagtgtgtgttgaacccatttttattattttcagcttttcacccatacttctatttcatgttttttaaagatatgcaaaaattcatttgcaagatatggatatatacatgagagttaaatatataaattctaggtataaaatttcctaactcgtaacttcaacaatatattgcagacgaatttattgccaatatacataaactcttttttcagttggattgtattaacaatgtactctaaaatatttaggacttcttttcttttaagttaagaatattactgtaattctccttttaactttttctagataataaaaaattaatttctcatcctctttcacgtttttggaaacagatcccctctttcctattttttcttcgtcttctcccacccaaccaacctcccctgtcaagatctcactggctgcaacagtatacacattgcaaaaattgtgctcataataatatcttatacagtgaatcagatcaattgttaacaaaatgatacaatttggtggaattgtaagtattttcaattgttacgctgtgctacattagaaaagcataataaattactcaatctgctccaattgcaaaaccaaaactcaaattctcatttatttttatgggttggtgggatttggttgagagaaatcactatcaatgactccaaatatgttgttgcataaggtaagtggtacaaatagaagagaaggtcccagaccccagtcactgaagaaaaacatttttatttttcagtacgtgaatcagagtgttacattggttgcaacacatcaattcgaatctactcaaattctcattttattcgttctccgttgtcgctctcaagcatgctagcgcataagtagaacaccaaacgtgcagatcggcgttgcaatgtggctcatgacaccattaaaaacgattgttacggaggagagaaaatcgactattttgtttttctttaactaaatatctagaattacgcactccaactgaaaaggagttatgtatattagcgtgtgtatatatatatataaataaataaataaagagattaacttattctaaaagcaactcctcttttagtcttttagaattactgtcactattatcatttattttcttaaaatataatgattatattgaataattaattttaactattaaattttaagaaaatattaagatagagtaacattttaaaattatttttggattacattattcgttcttttgctctctctttacatatgaatttgttaacgtacatatttctattttttattatgaatacattattaaactacatcattaatatattttaagataatctttaattataatttattttaatgcactcatactaaaaaatttcatcatattttctagccatgtctctcttctctatcactatcctattttaatccactctttttcatttgctcttaccaaatagaatgttatattttagtctttataaatcatccaaattataaaaatactgagtgaggaattttcgtcaagtatcatatcatcaagtgctacataaacaaaattacaatatcatcaaaaatgatacggtcatcatttaaaataacaaggagaatcttagatcatctttgttggtcatggataagaaacaattggtagttcacaacataaacttgatagagactagtttatatatatatatatatatatatatatatatatatatatatgcgtgtgtgttatatgtgtgtaacgttttatttaaataaaaaagtctctcaaaatttagttgagccaaccctgcccttgggtggttcagagttaactaattaaggtagtgcatgcaacctccatagcaaacaagttgcttgtggaagcatcttacgttcgtgaccataatggtcacttgttgcagcctagctatgcttcgtttctgggagagtgtaatatgttgcatgctgagcttaggggtatgttgtacgaaataaaacatgtttggaaaagggggattcgtaatatcttcagagtctgactctttaatttaggcgatcaatctcctctagaaataaatctcatgcatgctatatatgctttggcccagatccacacctcgtacagagagaagggagttgtttttcaatgggatcacatttctcatgaagtaaatcaatgtgatgatgccatgagcccatgacaaagtttggtttatatattatctactagttaatgttgttccagatttcatcttcctttattttactaaaattttaatattagttttgttttttccatcgtggtttttgagtttgggaaactgctaagctccctttattcaaaaaaataaaatctcatcacactttggataactttgaactcatatgacaaggagatcgagatgacaaatagaggtgcccttcatgaaacctttccgcggctaccaagatgtttgacttcattaggttacgagtaaatataagcaaaattgagagattaaaggattaaatacttctatttaaaatagggagattaaaattacaatattgagaaaaataagaggatcaaattttaattttggccaacttatttcatgtaattgattatatttataattatttgttatttttcacaactaattaatccaggtaaaattagatagatttatctcaaggcgtacaagtaaaataaatatatttttaattacttattttaagtttaaataaactgttaatgattgttggcgcagtggaccacttctatttccagtccaagcatgatacaatggagcgctaatgacatattgtcggtaaaacgtttcgtagccatttttattgtcggtaaaagaaatattaattgccactaaaaatcattttgtcgtagcgtagctaaactcaccaaacactttgagttcaatcaattactttatatattttcaggtttttaattcttaacttttaccttataattaaacattcagccgacttctaaattttcaattatatacgggtttcttttgtcaaatgtatccttaactgttaactacataccaaataagcaaatagtggatccgaatactacatttgtataaacaacaacacaaaatataggccataaaaaatgttttcttcatataatttgaacgtagaaaatatatttacattatataaattggatgcaacgttaggagtcagaactgtgcaaattttttctgaactccggtgatcctagtccgtgcaaaccttcgtttttaataaaaaagagaagagagtttaactcagttccctttcaaaattacgttgtacttgctgggaataattaaggacaaagaatggcataagaaccatgtttgcctccaataaaacgtggtgaaaagatttatataaggaagcgcgttatcagctctcccagaaaattaaaccagttgaagatggctgcatcctccctcttcaaacttctcctatcatcaataattctttgcactatgttgcagccatacacacatgctcttagaaaggcaagtatctaatacagttgtctgtgtttattttcacataacttcaactacaaaattcacattttgctgttggatatactatttttcacatgtttatgctttgatttgattctctttagcagacctacattgtatacttgggagagcattctcatggtccaagtccttcacttcgcgatcttgagtcagccacaaattcccattttgatttactggcatcagtcttaggaaggtatataaaatctagtgtattagttcgaattctaactttagtatataaagaaaaattggttggaagagaccaactaacctttgcctacctttaaaatctttgaaggagaattgtctcggtgaaaaagctaacatactttggcaccataaatcaccaagacacaattttactgttctgtcagggcgagtcctgagtcctctacctggactggactcgttctcattccatgcagtcctatggtataaaaaaaataatctttattctgtgacgctagctagttgatgactaaaatatttttgtttgtttattattttcacagccacgagaaagcaaaggaagcagtcatgtactcgtacaataagcacatcaatggctttgctgcactacttgaagaggaagaggcgtcagagattggaagtgagctaataaatgaataccatggtttcttttagatcttcggtagtatatataaattataactacgcattttgatgctgtacgcatatatatgtgtttggatctattggtgcagaaaaggcaagtgtaatttctgttttcttgagcaaagagtataaattgcacactaccaggtcatgggactttcttatggaggaattcctgcagaatccgcttggtggaacggaaacttcggcgaaaatacaatcattgctaattttgattcaggtacactaaacttttagttgttcttaatacaagagattttggatatggcatatctaaactgagtttgtttcttagataagtaagagtttatcaacatgtttttctataattttttctgacacattatttatttttgggccaaagaaagaatgtgatggatcggaaggtgttattccatttctattgcctttaatttatatttttccctattaacaatatatattcctttctttgtgctgaattaattaataatgttcccaattactaactgaattttttttatatatattttaagacatcaagtatatttattttttataataagaagaacatatcataaaaagctataactttttttttttaatttgaacatcttttacatcttaatcttcatacttattttgtagttttctttatttctttctttctttcttttcctcatatcaattagctcaatcttacttttttcttcctccacactacaaaagtatacacacacttttttaagatgtgaaaaaatgattttcatttaatataaagtaatttataattttaattcatcaaatttcaagaacagatatacttccatttatatactttagaaatgaaatctttaatttgttatggttggaagtgaattactgactgtttacttgttgaacaggcgtttggcccgaacacataagtttcaacgacaatggatacggtcccgtgccatcaaagtggagtgggaacggggtctgtcagattgaccattttagaccttcaaataaaacattctgtaacaggtcattttctacattttttgtctgtctctttaatctcactaaccagtgtctctaaagacatgtcaaatgaaacagatatataactttgaatcttttatcatacaaaaaaaaactttgaatctatgattaattatgtgcaattttaaatgttaataaagttagtgtaatctgagtagtttgtaagaatttataaattcaaacctctaaatctactaaataaatacataaaaattaattaaaaacatttgtaaagcaaatgaaaaagttccttagcatatgtgacagtacatgcataaagcaggcacatttgtgagtgcatcagcatgtgacagtctatatatatatatatatatatatatatatatatatatatatataaagcccaatatgcactttctatttccacggacttttgcggatctgtttttatataagcattttatatgttggtgtgttaaatacaccaagaaaaagaattatagataatacacagctatgctatatgatgatgaatcaggaagttgattggagcaagagtcttcagtgaagcttacgaggcacaatatggcaaacttgatcccttaaaacgcactgcacgtgactttgttggccacggtacacataccctgtcaactgctgctggtaattttgttcctggtgcaaccatctttggcaatggcaatggcaccgcaaagggtggatccccgagggctcgtgtcgtggcgtacaaagtgtgttggtctacaaatgatgctggtagctgccatgaagcagatattctacaagcatttgattatgctgtatacgatggtgttgatgtcatttctgcctctgtgggtggctccaatccttatattgaagctttcttcacagatggggtttccataggagcattccatgcagttactagaaatatagtcgtagttagctctgctggcaatgatggacctgcacctagaactgtcacaaatgtggcaccctggtccttcacagttgctgctagtacaatagacagggattttctcagcaacatttctcttggtaacagacatcacctaaaggtaacatgaacaacatttttcttttatatctaactagaagaatttaatataacttgtaagatacttaatataaaagtcaataaatttatcatataagataatttgtgattgaatgacaggataaataacaaatttattttttgctatatgattagtatataggggaaaccatattgtatatcaatttaatttaattgggttgcatgtatatgtatcagggagccagtcttaatagaggcttaccatcacggaaattttatccattggttcatgctgtcaatgctagacttcctaatgccacaattcaagatgcgtaggctcaaattcccctaacttgcttcaaatatttacgttattggttagatttttattacttcttgtttcttatatgagtgtgttactaccgtagtggtctttgcaagccaggagcacttgatcctagaaaaataaagggaaacatattgatctgcattagacatgataaaacaacatcagttgctcagggttacgaagctgctaatgctggagcagtgggagtgtttgtggttaatggcaagcaaagtggcggttcacttctagctgagccttattctataccaggtgcaaatgtggatgtcagtcaggataaggatattgatgaacgcgaatggtttgaaaaaggaggttccgacgataacaatagcaggtaatcatatatcacttaatggtttaatttgggattcaaaatcaattttccaacgggagaccaagcatgtacataaactgcatactccattacccagaagctccacgctatacgcaggtaaggggaagacatattgtacacagccttacccttgcaaatacaaagagactgttttcggattggaactcatgaccaacaagtcaccaagaccaagcatgtatatatttatttaaaatcaggaaagttggtatttcaaggtcattttggatgatctgacatgaattcaaacagacactaagccatttcatttcagtgttacttacattctaaaaatacctgcagcaaatgaaaaacttcatctataaatttctctgcaggaaacttgttgcttacatgactgtagcaagaacatatttaggaataaagcctgctccaattgtggctggattctcatccaggggtcccaatgcagtgcagccattgatactcaaggtctacatttcatttcatcatgatatatttttcttttccattttcttacattcaatactttattttctatttcagcctgacataattgcccctggtgtcaacatattggctgcttattcactagccgcaagtccatcaaatcaaccatcagatagacgtcgtgttcctttcaatatacaacagggaacttctatgtcttgccctcatgttgctggtgtcgttggtcttctcaaaacacttcatcctgattggagtccagcagctattaaatcagccattatgactactggtatgttggcaaaaataatacatctatatgcatataccaaaagaaacattgattacccttttaactttgtcaaaaatataattaaggctttattgtatttttagtctttcagtttttgtcgtttaaatttcaatggcatcaattgataattgctaagcatttcctcatgataaatgggataaaattcaaatcacacacttgtgacctctgaggaactaaaaatgcaaaataaaaaatctgttttagatgttgaaaaaaaaaaaaaaacattgcactttaaaatttggaaaaaaaattctgacagaaattatgctattcctgtagctaccacacaagataacaacaacctaccaattcgggacgcatttgatcagatagcaactccatttgattatggctctggacatattcagcctaaccttgcaatggaccctggacttgtttatgatatgagaacaagggattacttgaacttcgtgtgtgcccatgatcacaaccaatattttctcaaatactttcatagaagctcttacaattgtccaaagtcgtacaacatcgaaaatctcaactatccttcgatcgcagtagcaaatcgagggatgaaccctataagtgttactcgtacagttacccatgtggggactccaaatagcacatatattgcgaaagctaacgtaattgaaggatttaaggttcttgttcaaccaagttcattggctttcaggacaattggagaaaagaagagctttcgtgttattcttgaggcaaccagttggcctagtcatggttttccagtatttgggaacttgtcttggacagatggcaatcacacagtgaccagtcctattgtgatcctgtaaccttagaaatgactctctgaaatgttatcattgtcgtttgtgtctgatgttattaggtaggaagtctttaagtgcttttttattattggaatgttgtatcgaacatcgtttcattggagctgtgtttgtattaggcaccctcacaatcatgcatggagcttatatgcaaggataattctaacatggaataacttacggtcgtaaaactgatcaatgaaactttttctttctgattaaaattattcacattaatgaattgtacaatattcttaatcctaatttcttgaaattccacatcgaataaagatataaagatactttacttcatataagacttagatcgtctctagcttacaagttaatattgtgagatccagataggtcttaaacctaaattttaaaatagctatagagcatatcctaaatctgttattgggcatttgggtcacccaattatagtcttacaaagctttggcattcttcaccttacagttttgtggggttaagatcaaattctatgataattaaacccctaatttagttgtttctagctactttcatgttgtcaccttgtattatttttcaaaactataggaagtgccagtgtactactggtattgctttcagtgagagtgatttaattatctatcgttatggactttttaactcagcaaattgttatccattgtatataacagtgatccaggcatccagcggatctttgtgatgtattttgctgggccttggtttcttattttgtaacaaatctgtttaatatttactttaggattgcagaacatagtcttagtctcgatctatattattttcgtttgttgaataagtctttcaagtcagtaatttttattttattttgaaaatgtttttttttcttcctttttttgtagataaagattactggaatattggaaatttataatttttatgtttattacaagtagtaaaaatgttggctgatagtaaataaagtagaattcctacatatctaaattgtaaatgttaagttggctctcaacctttctactgaaaaacctttctactaaattgtaaaataatgagagtttcagaatttatcaaatttcatgatctttagacatttcctttgtgcggcatacactgatgcaagtttatgtagagctaaatttcttttcttttctaaatgtatgctatatacaaggatgcagttaatctgattaaccaaccttgtgacttggcctccttatgataaaccgtaacaaccttatcatcagctttcttatcaaaatatttttttaatattcttcccattgataccagaaacattatagaatcattttaatatttaaaaatagatgaatcgtgaattttatatataatatagataaaattatttttcaaaaccaaacttgtcggcctcgtcaccacgctagaaataacatcatcgtctgaaatacattaacttgagcattcctttttttttttttttcaatttgcctttttaaaagtgaataaaaaatttaaaattgataaaataaaagtaagtaaagggtgcaatcaatactctttcctttctcactttacacgttagtttttacttaaaagagctgaatgcctgagtcttagtcttccactatgtatatcctgaagaccttaattaattagtcttccactattatcttgaagtcttaactcaagaatgattacattctggataagaagaggcttttatattagcgaataagaggaggctctccaaagggaaaacttttcatttcaaactcttactataaaatggtatccaaggttttaaaaaatagtatccaatgacaatttctgctgacaatttctgctgcagtataaaatcaacgcagccacatcagttacatttatctgaaattttgcatagaaataataaagtgggtcactccatcaaaaatgggttagattgatcataatctatacaaaaaataagataggttgggctagctcactttacaaagtgggttaataatgctagcacatcctattttttttagtggattaaatatactgactcatcagattaagtttatcttgttatctttttaaatctatgaagatgaaaaaatgggttagtttactaaaaatgggttgaattgaccctaattcacaaaaaaataagatgaatcagactgattcacttggtaaagtggactagtaatattaatttatcccactttttttagtgagctaaataatctgtcccaccatattagacccaatttatcatccctaattttcctatacatcaaatattgcaatgaaactctaacgggaaatttaaaacctttattgcatacatatataacatgatgtatggattgttttaaatccttaatgttaaaaattaaaataacttatctttaataaataattttcaaaatcacttaatttgatatataattttattaaaccaagtaatttgattaaaaaaaagttggaatttacctgcccttcacccgtcatgattgaaaattgaaatatacattctatgatataaaatgttaatttattattatctcatttaataaaattattaatttttataataataactagttaaaaaagtcacatctgaattctaacccattaaccttgtaaagttctgttacatcaaaatctaactttactcgttcacatttttattcttttgttaaacatcctatgcttcatagtaggtgaagtttggaggaaattaaataacaaacgaatttttttatgctttacggttcaattttaagtgagagtttgagataataatcacatgtttcacccgcaggttttattatcatttgaggatgttttatttgatttattattattttgagatcaattttaaataattttctaaaagaaaatatattataaaaggtcgtaactaatgttattatttataatttttatgtatttttttaattaaagttgtaaaagagttgaagacttcagtttaatttttttaaaaaaattacaactttaaaatcgtaatattttttattttttaaactaaatttgtaatattttttatacttcaattaaggttttttaaaaaaaaaattatgactttgaagtcgaatgatttattttttgttttatgactttaaagtagatgattgcctttttttaaaagttataattttatttatgacttctattttatatttttaatatttttaaaaaattgtaaatattttaatttaattatttaaaaatgaaagtatttttaatatattttatattttttgaaatttatttaatatattattttatttaatatattttctatatgtttctacaattatttattaattaattaaataaaaaattattttactattttacaaaaaattgaaaaaacaataaatttgttaaattggaaccgttctaaaaaaactaaaaattcaaaataattttattttaaataattaaattaaaaaaatatttacaatttttaaaaaagtataaacaaaaaatatgaaatgctaaatttaaaaaaaatgtaaaaatataaaatagacgtagtaaataaatttacgatttctgaaaaaaaaaagtaatagaacttcaaattcataactcttaaaaaaatacttaactaaaatcataaaaaaatttatattttcaatttaaaaagtaaaaaaaaaagttacgattttaaagtcattttttttttaaattaaattgaagtcgttaatttttttataatttcaaaaaataaaaaaattatatgtcgtaacattgattacaacttctaactcaaaaattatagcatatattatcatttatgtccttttaaaaaattattttaaattgatcttaaatgataataaaaaaaatgcccctaaataataataaaaccctcacccgcgagaactcgagttttctcaagtgttcagaacttgcattacaaggtttagggacatgtttcagtgcaactaaataattaagagtgacatcgttacctattttatagtagaaaaatctgtcagaaaattgaatcaacattgtaagtgtttttttattccttataattaaagactaatattttaagatttacaacaattttactcaaataaatgagctagagccatagtaaattataattattgttatcagttatggtggtgttatcatttattaccacatggttgatgttattatttaccactaaataattaggaaattatacccatgtattttttcaatttaataaatattatacatgaagtaaatttagaactaatatcattaattaagattcaaatatgtatttgaataatatttatatattaatataatgtttataatttaaaatatcattttcctaaacccatacttgttttaataagttttattgtaaccggtttgtctaaaaatatgggtacccacgttggcaaaaatttaaaaaaaatacaatttaattatttaattagcaaaagggggcagttgaaaaaatatttagcaaaatggggtggtcaaacacgcccagctggggcgtgtttaaacacgcccagatggggcgtgtttcaccagatggcgccacgtggcaggctgaaacagtgttctagggttttcgcggtgttttcgtaaattacggaaggtcgtaacttttgactgggacgtccgattgacgcgaaaccggtggccacgcgctcgaaattgagaggagaaggcctgggcaagttcccgaagggtttatgtttagggtttcagattttggattttgggtataaaatttagggtttgggatctagggtttagggtttagggtttcagatttaggttgatgggtttcagattaggttaggggtttatgttatgattagggtttcagattttggattttgggtatcgaatttagggtttaggatctaggatttagggtttagggtttcagacctagggtttagggtttagggtttcagacctagggtttagggtttaggtccgatgttgtgattagggtttaggtcatcggttacagacttaggggacttaggttgtatggattccggtctagggtttaggtctaatgttttgattagtgtatagagcttgggttacagacctaaggtttatagattctggtttagggttaggtttgatgttgtgattggggtttagttcttcggttacacacttaggggttatggatctcggtttaggatttatgccagtgaataacctaatgagtgttacatacacttcactaatattgagtaattagttttccaattcaagttttgccttggcaagcacttccttaactgcaattttctttgattttatctcttcactttgcttctgttttctcagctctttccttgagggtggggttttgggtttacgatttagggtgtagggtttattgtttaggatttagggtttaggatttaggatttaataaactctaaatcctaaacaataaaccctaaaccctaaaccctaaaccctaaaccatacaccctaaatagtcaaccctaaaccctaaaccctagatcctaaaccctaaatctgaaaccctaaaccataaaccctagatcctaaaccctaaattcgatacccaaaatccaaaatctgaaaccctaatcacaacgtaaacccctaacctaaactgaaatccatcaacctaaatctgaaaccctaaaccataaaccctagatcctaaaccctaaattcgatacccaaaatccaaaatctgaaatcctaatcacaacgtaaacccctaacctaatctgaaacccatcaacctaaatctgaaaccctaaaccctagaccctaaaccctaaaccctaaaccctaaaccctaaaccctaaaccatacaccctaaatagtcaaccctaaaccctaaaccctagatcctaaaccctaaatctgaaaccctaaaccataaaccctagatcctaaaccctaaattcgatacccaaaatccaaaatctgaaaccctaatcacaacgtaaacccctaacctaaactgaaatccatcaacctaaatctgaaaccctaaaccataaaccctagatcctaaaccctaaattcgatacccaaaatccaaaatctgaaaccctaatcacaacgtaaacccctaacctaaactgaaatccatcaacctaaatctgaaaccctaaaccataaaccctagatcctaaaccctaaattcgatagccaaaatccaaaatctgaaaccctaatcacaacgtaaacccctaacctaatctgaaacccatcaacctaaatctgaaaccctaaaccctaaaccctagatcccaaaccctaaattcgatacccaaaatccaaaatctgaaaccctaaaacataaacccttcgggaacttgcccaggccttctcctctcaatttcgagcgcgtggccaccggtttcgcgccaatcggacgtcccagtcaaaagttacgaccttccgtaatttacgaaaacagcgcgaaaaccctaggacactgtttcaccctgccacgtggcgccatctggtgaaacacgccccatctgggcgtgtttaaacacgccccagctgggcgtgtttgaccaccccattttgctaaatattttttcaactgtccccttttgctaattaaataattaaattgtattttttttaaatttttgcccccatatttttgtccacctcgacaaacatttcgtgacattgcccgctatctaacttctatttgtttatatgttattcaagttggtcaagtgtttgaaaagcatatcttccaaaacaaatatgattccctcaatcatgtaagtattaatatatggtttgattgttaagctaaattgaatagacatattaatcaatgaagttaaatataaatttatggcttacatatctctttagttccggtatatattgcttttattgttttagtcgttaaaaaaattgttttctaaaaaagatttctatggaatttctttttattggttttgttccttgttattttgctttagttctcgtaatatatatatatatatatatatatatatatattagtttctataattttttttttcattttgaattattctctttgaaagttatttgatagagactaaaaacaaataatctatatattacaagaactataacaaaactataaggacaaaaacaaaaaagaaaaagaattttacaagggtcattttaaaaacaaatcataagaaccaaaatatttaaacaaaaaaagcagtatgttagaagaatcaaaaacatttttttgtctaaatttatttatttataatttacctacatttctataacatttatttcctgtaatataattttattatgtttaattaccatttagtccctgcaacaatatttccttttattaacccttgtagtttaaatttgggtcctatagtcattttttatacttttggtcattgtcgtctaaaattataacttaatgttgtttgaaatgaacatgaattaaatgagtcttggttgtcatgtttatttcaaatgaccgatcaaaatttgtaattataaaggcaaaaatgcatgggatattttaaattatagagactaaaagaaaaaattattgtaattataaaaacatattagtaattaaatcatgttcttatttagaatttctcataaattacatttaaatttataattaagttacaattattaattaatgtatatattaagttttattattattattttaaaatataatgattatgttgaacattactgaatcattttactctgtcaagaaatagtgaatcattttactgatgtgcatcatcaacttaatttatatataatgtagatatatttattttcaaaattcaaattgtcagacgggtcactttactagtttagtagaaataagaacatcatcgtgtgaatcgtattaacttgggcattcctttttttttttttttttgttttttccttttttaaagtgaataaaaatttaaattataaaataaaaagtgaaagtaaagggtacatgataggcactcttcctcactttacacctttatatgtatattttataagacctgaatccttccccgtgtgacatcactatgtatctcgaagaattttggaaatagtgtgtacattatttgtaataagaggttctttataaattgagagggaggctctccaaacatcaaactttgtcagacaaagctctataatgattaatgaagtcgtctattaaaaaaaaaagaaaaaaaaaggagtctgtcacaattcccataatgcaaatccataagtttatatttcaatacgtttatcttatttgtttgtttgaagaaaaatagagtgggataaaatagaaaagagagagggaaaatagaaatactaaattaatattatttatttaagtggaaaaataaaaaggagagaagtacgtgaacttaaagcaaagaagcctgtgttgaaataatgcatttgattaggcagttaaggtctttgattttgtcccttcctttttgtatcatgccgttttggctgaaagttgtaataccgtgttttcttgcggattttagtgttcttggggttttctcctgttttttcacacaaaaaatatattgcatctgatttagcctattttaatttgttttggggaattatttaacttaaaaaaatagagacaattgctttagaaaaaaaaagcctaatcagaccactttgctttgaaaataaataataaaatgaaattatatatagaataaacaagaatgaagcctcatatagtattgaacaaaattaatatcaagataaatatataagggaagataattttcactttataaatcaacagtatatgatttagttattacacttaaactcacattttagaataatatgagaatctattttaaagtcacatatcatgttattcatgcactaaatctaaaaatattttaagaagacgtataaacctaaatattatttcttgtgcaattaatatatttgttattgttgagaaaaaagtatcagatttattagaatgatacaaaatataaaatatataaatgaagaaaaattttatttcataagttggtttggtaagatttagttaaatcaaaactcacattagtgtaaaaatgtgcatcactcatgtttaagctaaagaaatttacaaatggagttatgttttccttagattgattggttgtacaagacacaaaaactcataaattgatttatcaaaagacgacttccttctttcttttggtggacccaaaggaacgacttcctttcttttcttttctgttttttggagaggaatgacttccttttgtaacaaccccgagatggcgacatgacatgtatactagggtagggataagatttttttcacataagataataaaaataatcactccaatatcataatatttattagaaatctattttactaaaatatttttattgtctttcttatttttacaaacatattaatcttaaatatgtttttaatctcttaaatatattagtttcttatattttataataatgaataaagcttttaattttgaaccaatcaaactacttaatttaatttaattaatttctcattttatgaaattttcatataacatttatttattaaaattcataatagaacattatttataaaaataaatattttaatcaattgacatttgatttaataaaatgtttaattaattaaactttgttgcagataaataatcttaatttttttatttgaaaaaaaaaatgatccgcataatagttttgtgtaaaatatataacatttgtaatcaaatttattcttcaagatatccttatacgagttttcttgtagattactaaagtcctaatatatattgggacttgggagtgtcttcaattaaatgcaatacacttcatcaagttgctaaccgttaaggtcagataattctcacagaaatatacagtcaaaatatccttatcttaccaaaaacattacttttttcttttgataaagtagcttttttatttatttttatgtaaagtgactttatttattttataaagaccaaaaacatgaccgtctcccttcaaaatcacactttatttattcgatcttacaaaagatataagacaactttccattattttctgtctttacagaacagaagaaacatacaaagcactccatcagaaacatacaaaacatcctcgagaaaaacattaatatcaggaaaagcttaattacagtgtacaccaaaaaactaaaaaacatacaacacaccagaaaacaagttttaattatttagatagttgaccaagtgtgatcatggggagtggatccaaagaagatgattttggcatcacaaactcgttatgcacttgttccatagttgggcgaaagcgtggattctcacttaagcaagcaaatgttaattttgcaatcaagatcacttcttcaacaattggcttcactggctgaggtagtcgctggtccaacacatgaattaatagcatattagacgcagatgatgaaaacaatgaagaaatgagatctcctggatgcattcccattattatttccaaacaaagcactccgaaactgaagacatcacatttctcattcacttccatagtataagcaagctctgtaattcatcaaaataataacaaaatagtattataaaacaagtagcaggacttattattgaaacaagtatatataggattaaattcttaagaacaaaaatggcctaacctggtgcagaatatccatatgtgcctgcaaacgctgttatattttgtgaatcaggattcagaattttagctgttccgaagtcagagattcgggcttcataatccaaatctataagaacattcttgcttgatatgtcacgatgaacaataggaggaaagcaaccatgatgcatatggtacaaagcacttgccacacctttaacaaccttcaccctcctttcccaatcaaacattgttgcacgcgtatcatcggttagtactttatccaagctaccaccctctatgaactcataaaccaaaaaggagaagcgtgcatgtaaacaatatccaagtgacttcacaatgttacggtgcttgatttcggccaaggctttaacctcagctgaaaaagctttcgaatcgggtgtttcctggttgggtgcagcatgaagttttttcacagcaacaatctgtcccgagggtaattttgccttatagacagatgcagtacccccttctccaatgagatatttatcatcaaacccctctgtggcttccatgatatcttcatacactatttttccatcataactccaaagggaataatgattctcacttttttcttctttatcctcctcctttttggcctttgttgctcttcggtagcaaatacataacgaaattccaaccaccaataataacagaaatagagcgccgaaagaaaggagtaatgccaacatgatgacatttcttttcattttaccatgaggtagggtgtggcaaggcaccaaaccggaggcatttccacacaagcctttattatttttcaatgcatcaaatgaagcattaagaaaggctggaatgttaggaattgaaccctccaattggttgttagatatgtcaacatttgccaagctattcttaaaatcaggaatggctccagagagattgttgtgcgagaggtttagcttttccaatctttgcatactcgcaagtgctgctggtatttctccatttagcaaattccaactaagatcaagatcttgaagagattgcaattcgttaaattcccaaggaatgctttctgtgaatttgttgttgctcaagttcaagcgaagtaatttaagtaaagatcccacctgttttggaattgggccacctaaattatttgctgcaagctccaatttttcaaggcgggacaaagaacctatttctgtaggaatgttacccaaaagttcattgtcgcctattgatagctccaacaaagaggtcaattttccaagttcttttggaatttttcctgttagatgatttgaagacaagaaaagtctctgtaacttgggcgcctggccaagttctaggggtataccaccagataaattgttgttggacatcataaggcttgtgagattaggacactttgcccagtttggtgaaatgtggccatgaaaattattgctactcagattaacgtagtccaactctggatatacaccaaaaacatctgatatatttccggtcatctggtttccatctagtctgagtctagaaagactggagcaatttttcaggctttttggaactggacccgtgaaataattagagttaacagaaaagtctttaagtgaaccaccaaggcaaatttgttgcggcaaagggccagtgaaattgttattagatagttgtaagcttatgaaattggtggagttattcattgcgggtggtaatctaccattaagtttgtttttatgaactagtaaataggtgagctttgtcaaatttccaaaggtggaaggaataactccggaaatattgttttcagaaaggtctaagatcattagattgacaaagtttccaatggaggtaggaattgatccagaaatcatgttatcgccaatggacatattgactagcttcgtcaagtttccaatactggaaggaattaatcctgaaattttattttgatcgatttcaaaaacaatcaaattgaccaagtctcctatggaggatggaatggagccagaaagactattgtttgagagctgaaggcgttctaaatttgtcaagtttgtaattgaagtggggattgcaccagagataaagttacttgacaattcaagtctaacaaggttggacaaccttccaattgttgggggaatggtaccagaaagtcgattcccttgaattattatacgcttcaagttctgcaaatctccaatctcctcaggaatagaaccagaaaggttattgcgttccaagtttagaattgacaagctagtcaacttcatcatgaaaatggggattgagccactaacattattagcattcattatcaattgagaaagtctggacaagttagcaatttgctgaggaatagttccagtaaaactgttgtgactaatatccagagttagcagcttgggaaaggaagagaagttgagagtgtgaagagtaccttttagcccaagatttgtaacatttatgatggtcacagcgttggattcgttacaaacgattcctttccacctgcaaggactgacagcacttgtccatgaagacagtgaagcttggctttggttgtcaaggctagctttccactcaagtagagcatttgcttccgtcccttcataagcagtgatggcagcaaagccaaaagatgaaaacgtgaaaacttgggaggaatggaggtttaggagtgaatagaaaatcagtcgaattaatgaaagcttagtgaaaaccatgtttgagctactgggtgattatgggaacgtacaagatgttggacgctcaaagctaccacgttccttcctatatataacgtaagactcaaaattttatgatttttaataaattttaaattctaccaaacaacgttataatttaaattgtttctaaagacatgtcaaaatgtcattacacatttaacaatagatccgtaaaatgagcaaaattgaaaattattgttatgataaaatctgcggaaaatattcaaattgtaaattcatgaaataattataatttagtgttacagtgtacaattaaatatatgcaaaataatcaagagtattttagtaaaaaataattaatataaaaaacaatgtaaaagagatcttatcgaaaaagaaattctcaaaaaattataggatggatgtagtagttataatgaaatagcagaaatgctggtcatggtcaatatgtgaaagactgaaagaacgcgtacaaacaaattgaacaaaagcgcaattacggacttacgtacggtcgataattttttgagtgtttattaaattatgcttaaaactagttcaatatttttattttattaaaaaaagtgaaattttgaatttttaaaaataggaatagagatagaaaaaaccatttaaatgaaaaatgtttcaaatatatttttaattcctataacatatttatttccttataaaattattttttaaaatgtttcttgtagaaaaaattagttttattattttttattttattttaattcttataatatatttattttcttttatttttctttgtaatatatagattatttgcttttagttcttattaaattagtatagtctaacatcctctcaacaaccactctattaaagcaaagtattgtacacgttgtgaaaactggcccggtcattaacccgatcgagatagtggattactgggtcagtggttcaaccggtggatcaataattggtcagatttggtccgatctatattaaaaaattcaaaattatattatatatacgtatataactagtattatttgataaaaaaaattcatccatacttctataatgaaaaatccaaaataacaattgaagtattaaagttgataacacaagtaaagtatattaaaaataaaaaagactgtaaataacaactacctaaataaaaacacaaaaactcatttcaaaaagttataaggaaactgcataaagcaaaaaaatggataaataaagcaaattaggtccaaagaaaccccgctagataaggaatttaaaaacctatccactatatatactttcttttcttctctgttgaatgttggttgcggctgctgcactttccattgaagaccatttcttcttctttggctgaattttttgtactaaccgcatctattgaagaagaaagcgttgattaaaaaaatgcattgttgttgagcattgattaaaaaaaatatattttcctctcggtcgaactcactcttttatttccagcgcacacttctctttcactgtcacagctaatggcggatgaagaagttgtggcacccgctgccagccccgttccctctgaaaacaaaacaagctcgaagatctgcaaaccgaaaacaccaaatctaatgccaactccatctccaaagccgtgaacgccgatgaagccatcatttccgtcgagacagagaacaagcgtctccgtctcgacgacgccgttttgtgcgtctaagcttttttttttcttcaccaactcgtccgggtcctaaaaaccgatcgaatttccgattcttctcaaaaccgtctgattttcttcggaccaaactgggtcacatgcatgaccggttcattagtcaactcgatccgattgatgctccaatttccgattcaaccaattcaaccggccggttcaaatcaatttttacaactatgattgtacactctctacaaccactccattaaaattaagaaatttagtttatcttatcttaatactatattaacactatcaaataattccatattaagctcccttaattaagagttaaggcctatatatatatatataaaattaaattctcaaagtaacatattattttatccagtcacttagtacattcattattctctctatgttgagacttaagttgagtatgggagtattttttttagatgtatctcaccttcggaggatagttttgccatgtaataagaaattacagcccgaaaagaatgatacaacgagaaggaaaggacacaacaagaagagaaagtattcggtcatctttaaacaggaacaactttagattttgagtctaagatgttcaatgcttacctccctatggccatctcaatttgagcagacacaaaaggaacataggctatctccctaacgtttagtttctgtttaaattaaacaagcataaattacaagaactttcccaaagtttggacttattacacgacatccttatgttttttaacgatactttcagccccatcctttaaacagcatgaagaatccagatctgccccgactttcagttgccgccgcggaggatgatagcgtgattgaaggaggagtggtcaccgctgcgccgctgtcagagtttcgcaggccgcgccacgggaatccagatctggttctcactccttcatatataaccgggttcttgaagtttttcacagggtttcttttaattcttcaatgggttcttgaagttttttaaattttattgttcttcaatagttccgttattggcttgttgttgctatttggttgtaatctgttattggcttatctgtggagtgcgagatatataaaagaatctaatacattgagaaactactgtgacgttagttttgtttgttcttgtaagttcacagaagaaatttccagttttgaagggtattaaacttgccattgtaagcggattgggaagcagatgtgtgtgtaaaaaaattattcatgtttttcattgcctatcttagtttgtttttgaaatttatcttctaaatttttcgtttatagttaagtgaactccagatcaaataaatggtttaagaaggaaatggtcatttttggacagtgcttcaatttcatgtgctggaaatcagtagcaaatgacggacattcttgaaacataatatcattaaaaacccgtgtcagtcaagtgtgcgcttctgttaacagagttaagtaagtttgagggtgaggggtagctgctattatgacttatgagagccattaaatatttaaattagcggaatttctagggtgaaaaaatgaaggaatagttaagggaagtatgtgtaatttacaaagaatttttcctttcatacgtagactaccaaattcataaaaatgaatggcaaggatcaataatttgtttaacatattattaataaagttaaattgtaattttagtccctcttaattttctaaattcatgattttagtttttcctaatttttaattataacatttgatctcctagttttataaattgatgattatggtttcaatgattgattattaactaataattataattaatagagttattaagttaattataagttaaataaaaactattaatcattaaaaaaaccttcataaaagattatttaaatgtgttgctacttgaagtcatgtacaacaatggatgtgaaagagatgtttgtataaaagaggagtgcaatgttgtaaaggattaggattaataattcttttattaatgtttttaataattaatggtttttaattaatttcataactttattaatcacaattgattattaataatctaacaaggaactaaaattaccaatttataaaattagatgaccaaatactataattaaaaaggtaaaaccaacataaattaaaaaacttgaagaataaaattacaacttaacctattaattaaatttacaaaattatagccaccaatgacttggatttttggatcaagtcaatctccaaaagtcaagtaagtatcatcatgactccgtgtttgatttatgagaaaccaaggaaaagaacaagttgcgtagttaaataatgaaagtttcatctgtttttcaaaaggaaaaggaaacaatataatcttaaatatgccaaattacaaacaggcacaacaatcttacctattaatcaccgcatcccacagttctaattacctctctaggacctatgatattgtaacgcccgaccacaaacttctcaggaggtcacccatcccaagattgctccaagtcaagcacgcttaactgtggagttcttatgttatgggctaccaaaaagtacactactacaaaaaaggccttttacatcggttatttatccatttctacgtcggttgaacaaccgtcgtagaaagagatgtcgttaataaatcaaaattttaaagtcggttgacaaccgtcttagaaaacgactttctaagacggttgttaaccaccaacgatcttagaatgtcattttctaagacggttgttagctacaaccgtcttcgaatgtcactttctaagacggtttttagttagcaaccgtcttagaaatctatattctaagacggttgttctctaaaaaccgtcttagaatgcagctttctaagacggtgcttacagaaaaaccgtcttagaaaagaacattctaagacggttggtggttaacaaccgtcttagaaggcacctttctaagatggtttttacatcacaaccgtcttagaatgttcatttctaagacagttgttatgtaggaaccgtcttagaaatgaacattctaagacgattgtgatggcaaaaccgtcttcgaatgtgcttttctaagacggttcttttgacaaccgacgtagtttcgtgtattttttttaaatatttttttaacgcgtacataatagtagctgcgatgattttgcaaaactattactggaccatacgaagtatataaaaataaatatcatttcattaataagaataaacacaaagtttcactaacaacaatatatataagataagatataacatctataacaatacacacctcttttcctttgtaaattctaatattctgacacaaagatatatcaattgcacacgacatacaagaccaccacaggtttcaaaaatgtcaaatgaacaccaaaagccagctattaagcccattccattcttattaccttctgcacaacttctccaccctgtggaaaataaaagccttggagtagtgttagcattaagagtgagttgtcaaataagatcagttctacatggaaattggcacaccagaaagttgtaacatatgcgttcttaagctacaatccttgacctgccagaattattagataaaaaatagcaataagaatattgatacagcatattagtatgagatagcttcaagcaaacatgattacctgcatggctgctaacgaggacaaaaactccttgcaatgttcaatgtatttagtgttgaagtgatccacttaaacagcaaaaaagataatggattctggacattgagattatggagattatattttgcaatacttgaattcaaaactattgaagaaataaacaaggaaataagttcccacgccttaatccaaactgcttgtcaacatataaattctcaatttcacaaattcacaatcattaactttcaaattaaaaagaaaaattgttgcaatctcaaaagttataaaagcataataacagcaaaatttataataccaaccacaaaaaggaaaacatagcaaagggaaaagaggatgatatttttaattgtgcaattggatatcagatattataataagcataaattaaatggctatttttatatatttagcaaaataaactaattgtgtacatcagaaattagctagccattatatgggtcaattatgaatataatgtcacatttaagaggacagaatataaatccaccaggagaagttacattaattaaaataacaataaaataaaaaagattactcactgtgagaggccaccctttcaaagtcaaattattgctaccttgatttgatcctgtcacaagaatagtaattaaacatcataaagaaaataacactaaatcccaaaatattgtcaaccaaccatgaataaattgcaaaggaaaaaaattccatcaacttgcagcaaaacagtttcaaaataataaaacatccatagactgtaactactaggattgttatggtcaaacaataaagagaacccagcttattaagctcactagaacatgtcaggtagctaaagaactgaaatggatgacaaagcaaggaccatacatacaaatgtacatttcaaatttgaaaagtcaaatgacagttgcttctttgcaaaaaataaaataacatgccctcctaaattctcataatagagtcttattctacagcttcatgtacagccaacatcatagattatttgacatcaaaatggtcaagaaaatggcattaagtgagacagaaaataattgaagaaacataaaaatttatgaacatttaattttaaaaaatcataaattttattagaattttataaattcagtttggacagcttattaagattttaaattttctattagtaatatattattatttgtgaatctcatttagatttgatttaaatttcttaattttattattacctaaatatttatgaatcatgtataagtaatattgaatttactaatcaaataaagattgaaataaagaatttttttaagattttttttaattaagctaaattctttttatataagaaacctaatttaataaagattattttatataagaaacctaatttaaggtagaaaacaaacaaaactaaaagaaaaaataattaattattttatatacaccataacctgttgctctctcattttcgatatccataataaagcaatatatgtgcctattttcaattcataatatactaaatatagtgtatgatcatggatgtatacgtgattggcttgcatttttaggactatcgaatagaataatatagaagtattataaataccttgttgctgatggtaagtgtttctaaaattgattttagaccaaatgccaatgaggatttatgaatattgctcacttgatctggtgtgacttaagattgaaaattaagaaaaatattaggatttaagttaactaagaaaaaaccacatttcccacaaaaaggtccacaacaatcaaccgatactcaacaaagtccaaaaatatagaaacttataattcagaaattaaaagttttacaaaatctaacacttaataaccaaaatctataaataattttataattttaaaaaattcagggggtgggggtaagccaagaatgtcccttaggcaaacaaatggctccatccttgcatgtgctaattgaaagtttttccttaattactcttattgtatatttactttcttcatatcattaatgtagtacacagatacttatagcttaaaaattaaaatagttgcttaacagccaatcctgaaataaacttggcaacgtgaaagtgcatgagcaatcaagtaaatgcaagttttcatatactcacatggctaacatgtaaagcaccaagttgtaagcagcccctgcccaagttgtttctgtcacaaacccctgtaatcaatataataagagcatttttaataagaaagtcaaaacaccatggttttgatcaagacaaaggaaatgtatagtgaattaaactgctttgcacaatgttaactagtgtagtcctagatttcagccattaaactgtttttcacaaattgtttatatttccaacctgcttgttggtagacttatggaactttctttagatctattaatgaactctggttttagagttaactcaacaagcttgtctgcctttgcaacatcaagaaccaatgcttacactatagagctactgtccaaaatagttccagccactaaggaatcatatcacaatgagaattggtacttggagaggctcctagtcctttcatctccctaaccacaatactggatagaaatgaaaactaataaataaggtgcagagtcaagaatatccagacagtacaaactacttataagaacaatatgaggaccaccacaaaatattgttgaaggtcagaaagaaattagaactttaaaattaccaagcctagggaagtgactcatgcaaaataaaactgttgacatttatactaaaaggagtgttagtaatcactattatacacttttttcaatatattctattattgattaaaatttattgaaaattttaaaatcaaaagagatatttattaaaaatgaaagtaaaactctctagaatttgtaatttcaagtaatagtagaaagtgtgttgaaagaacatactagcaaatatgttcctacttgtcaacatttatctttgtaataattactttaaaaattatacctagagtgatttgctaattacttttaaaatacctagatggcttttaattaattaacaatgtaagttttattttgatagtgaatgaaaattaacctcataaaaaattgtaaaagctaaagatgcataagcctataaatgtgaaggaaaagtttttttttttcacttgattcatcaacagggtaagcaatatattacttatgtatggtagttaattaactaaaaaataacagtgattaataaaaagagtaccgcttctgatttaataaaaaaataaaagtactataataattagtacaaaaaaaatgtactttaattagtaatattatttggagacttaaagtttgaaaaatacatcaattttctgatgattaaacaatatacacttctaagtttgaaataagattaattttacttgtcataacacattccctttatccaacagagttgccttttaaaattgcactgcctacaacgtatcagtgcaaatttctagtcccaaaatctgcaaatgcatagaaaataaacaagagactttaaaacaaaatattaagatattttttttggataagacaaataatattattgatataacaaaagatagatatactcaatgggtaccagaagtaccaacaagcttctcaaaatgattacatcagttaccaaaagagaatggtggctctcgagacatcatttttcacataactaattaacacccaccatattaaccaagcaaaagcataaattggtttaaaaacttcccctgtgtactgctatcttccagcttcccttatcccacctccagcaacgatgtttcattcatcccttcacgttcagaacatattttctcgcaagcagcaccgaggattgttggaccacgccatcaaagtgcagatctagaacatattcctgcactttgccgagagccaaaacaaataaacaaaacaaccaacaaatgatgatggccaaactgattaacagcgttatgttcggttcacctcaaagtggtaggcaaatgctttgtggcatatgagatatgaacaaataaaaggctatcctttttcatccattacaaccaacatggcaaaggatccacaacctgtaataactcttctctccacaacctcaccatattcatcttgtattctttgtctaagagtctaaaacataagacattgatgagaagatagacataaacttgggaaaacaacttctggttttaggacttaaaaactaaacatacctggaattctctcatgagatccttgaattttttagtcaaggcactgtggtttcaaggaataatctatattaagctttctggatcattttttcaagtacaataataaagatatgtattaccaacttactttgtcatattcattcttgctctgtcaacacctgttcccttctcacaaccagtttaatacatcgtcagcacctataccagaaaatgttgcaaccaaattctaaacagatgacttaaattaaaacataacatacccttgtaacacacctttcattgaagatgcttttgtgacagctttggattcctcattagcaaggggaagagagaaatcaagagggtagtcaccctgaaacacgccatttgatgtggctttcattggcggtgggcaagcatttttagatgtggcattggaagccatttcaacagtccaaaatatgtttagggccagttccagaaccagacaatgacctctcacaatttattattggttagtagtataaaataattctaccgagagtgtgtgatcgttacacttttttttacttaatgttattctaataaaaatattaacctcattcttaaaattaaagaaattacaaaattcagaatttaacagtttttttttactgaatgttattctaacagttttttattacaaaatacctgaactaagcttttgtcaaagcaattattcgaaaatcactggttttgaagccaaaatatgaaagtaccttttgcctcttgaataccaccaaatgcagaaaatatatcaaaacctccagaaaatactaatgcttagaaagtgttccttcaaacattatgaaaatacttaagactgtatcaaaaatagatgtcaataaatacacacctagtccaacctggtttctgtgccaaatattttctaaacctgcagagtagccagttcaccactttgaattgagcccatactccaagagctggcaaaatttaatacagggaaacagtcatctgcaacccttagccaacacttgagattcatgtcaaataggaaagcatgacgagtgacaaaaaacaaaaggacaaaattccgatacttccacctgtgcctctgcctcctgaatctccttttgccatctttcaaactcatcaacatcaggagcagacactacataaaattcctatgaaaatattttatgatttgttaatttaaaattattgaatggtttagattcaaaaatattaaaggttaggattagttttctgataatttaatagcagtaacagaaagatatattaatttaatacatgaagtctaaggattaattgagaccaaaataaagtttaggatgtctatttgtaaaagtatcaaatttagaatacttctattttttttgccttatcatttactttaccagggccccatgggataatttaagaggacagaaaatgctatttccctgtcttgccgagtgttttggagcaagagttacaatcatattcatttaaaacatgtaaaaataccaaatttttatttttttgttcaaatttttctaccaaactctacagtagctacattgcaaatcatcagctaccggcaagttgactccaattttcaacttgaagttgaacataaagaacaagtgctgtgtccagtagactagaaaggtaacagtcaaaattattgcccatctataccactatatcaaatggattgctgaagtgaaaataaagatgaaaatcgtacgttcccctggaatagtgatccgtcatataacctttctgaacaaagattgtatactttgtattttccctgcacatcaaggtttcaagagaacaaaattgtcagaagatcatagataaatagtcaacaacactcggtatatcaagatactaggagaaattaattgttgtagcaaaccatttagtgaaacaagaaaaatggatagtaattgctcaaatttatagaggaagttggagcctgggagaatttcaagatcttcaggtactcaaagtacatctagcagaagagttcaatatcactgtcaattataattaaatgttgggttgctgtttgggctactgtagatgagtgttgtatatgataccattaatccaagtgttgtagcagtgttattttatatttttggcatagttacacttttggtccctattcttcagcctataagcgattctagtcctcctaattttaatagctcacatttagccctgttagttttgtaatagttcaaagtaagtccctcaccttgaaatgttatccaataaataatagaaatgtaatagagatatggcatatccataattcgtataattgaagtggtgaaattaaatatacctagagaccatagcagctatagcaccagtccagagatgtttggtggtgttgacgacattgcatcctcgtaccctaacctttctctgctgaacgacaccgtttgaggttatctccgttggcggcgaggattggatttggaaaagggagtgccgtgaatcttgaacaaaatgaatcgaacgaaggaattgggtattttggggtcgagaaacaatccttcggtgaaggaaccaaaatcaggaatcggattgaagaaaatgggaggggagtgttcattttggtgctgacagagttcacctgcttgcattgccgttctcagacgcccgacgctcacttcaactttcaacacggaggtcacgacgtggttatagctagggtgagtgggtgcgcttgccggagacagctagggtgatggacaatgggagagggagaggaccttaagggatgaaagtaagttttagggcacgaaaatgattgggctgaaatttttaaaagcaaaaatggagacaattttcgaagacggtgataggcaaaatgtctttgaatagacaaaaattaagacggttaaatcaaaaccgtcgtagttttgaacatacatagatggttgtacaaagaccgactttgaaatattcattttaattacaaaaatgccaccgcaccgcaaacaatatcggtttcgcgacaaccgacttcgaatctctgtcgttaaatgtactatttgtagtagtggtagatgtaccttgttggtataggtagtacctattaaatcctttaagttattctcaactgtacagtcccatacctgcacagcctctggatccctctcggtattcgattcattcatgtacccctccagctggaagcctgccaggagccgctccttgtccgtgcctcactgcaccgacgatcactccccgccctcgtcagcgcccgggatgttacagatatcactgattttttggagttttagtctcacataaccgtatctatattcttttttttaaccccctctcttttcttcattatacaactatacttttaaactgcatattattgaaggccgtggcaagcgtgggggaccttctcaaggcccccacggtgggaaagaaagatgatccgtaagattgggactttttttcgagatgattttagttccacagtaaaatagtttacaccggatcaaatttattttttttctaaactgcatattattgattgtgccttttattttttgtgacaaagcacttcaatgcaacatgagcagaaaacacgcttatattacagcctaaaaaccaacaaaaggcaaacaaactaaaatgacaatgataacataacaatgctgagagtaatttctaagtgtccagcactacgattggactagttactctgtgcttgccatctgtccaagacaaattcccaaataaaggaatgttgtgaccaggcacaccaattgcctgaagaataacctgaaacttctttttttctccagttttcttaaaggtcaacgaacttggttgcacaagaaccttaatccccttcggccactgagtattcacaacatacgtgcttggaggcccaacatttgtaactgtacgagtaacattaatagtctttgagccaggatgatgcaccgtaattgaaggatagttgaaatcttcaattctgtaagacttgggacaactgtaaggggatttcaaattgagaaaaaacttgagtaaagcttggttgtaaccagaagcacataggaagttcaagtaatcggttgtgcttaaatcataaacaagtccagggtgaattgcaaggttaggctgaatgtgtccggcgccgtattcgaagggagttgctttcttatcaaatgcattccgaatcggtcggttggtgttatctagtgttgtagctgaaataaataaaaagcatagttgttaataagccgccaatgatttggtgtgcatgaagattttatattgatattactttggtaatgaacgtacctgtagtcataatagcagatttgatagctgctggactccagttagggtgatatgttttgagaagacccgcaatgccagcaacatgaggacaagacatagaagttccctgttgcacggtgaaaagaacccgacgtctatctgttgcaagattagtcggacccgcggcttgtgaaaaagcagcaattatgctcacaccaggacctgttatgtcaggctaaaaaaagaaacaagttatggttagccacaaattcatctctgacgaatcattaattgtaagaattaaaagttaatgacctagtcatgtaggtgtagttaacaaaatgtatatattatagacctttaggatcaatggttgcacggaactgggacccctggatgagaatccagctattattggagctggctttactcctatatgtgtttctgcagcactcaagtaagctaaaatctccctgcaacaacatatatataaattaatattcaagtgcttcacttgctttgctgcaagtatatgtatatatatacgacatttaaaagggattagtatgtatataaactttacttgttactgccgcctttaggattgccattcttttttaaataatgttcggtttcttttccaccgacacttgcagctggtaaaatatgatcctcggccagaagtaaatttccacttcccttatcatttagcacaaaaactgacacagcgccagcaagatgaccctgttggacctctttagctgaagttaatttattgcctcgaaggcagattagtatctttccccttacttttctaggatcaagtgttcccgctttgcaaagacggctacaccaacatacatacatatatatacacacgaaacgtataagacaagtatatataaatatttgagcaagcttgggaaacaaaaaataaaactgtgcttacgcatcatccgtggacacattaggaagtttagcgtcaacagatttaatcacggaatagaacttttgcgacggggatgatggtggtaaacctcgattaagactggcaccctgatacaagtacggtcaaattaagttgacatgataaaaatatgaaataaataaatctctagattagatctcttaccgtaaaggattgattgttgctgagagaaatgttgctgataaattccctgtcgatggtgctagcagcaacggtgaaggaccagggtgcaacgtttgtgacacttaaaggtgatggtccatcatttccagcagagcaaacaaccactatgtttttggcgactgcatggagtgaccctatggaaatcccatctgttaacaaagcttcattatagggattagacgcacccacagaggctgagatgacatcaacaccatcataaatggcatgatcaaatgcttgtagcatgtctgcttcatggcacccttctacgtccagattattccagcatgctttgtaggctacaacacgagcttttggagagcctcccttagcagtaccattgccgttaccttcaacatttgcaccgcgaacaaaattaccaccagcagttgacagtgtgtgggtaccgtgccctacaaagtcacgtccgctgcgtagccttgggtcaatcttcttatcttcggcctcccgattttttagaaaaattcttgctccgatcaatttcctgaatattcatcataattataataatattagggctacatgtgatagcaattagcatcaacgaattcaagaatttttcttgacatgagcaataaatagtttataatatatttttttttaaaaatatcataggaatttttataaaatatataatgttatgataaaaataataatccaaaaggctccaaaattgcttgcatgctattatgatactcatttatttatttttggtcttgtgactcttggaaaaatgattggggtattcttgttcttttctgaacttggatttgaaatatggatttggagggcagagaatatattctttatataaaagaaaacagactttttcatatgaaaccacaatagtcattgtgtaggaactttgtgtactaactttctttattgtactcttttttacttatttgaataataaaaaatagtattcttatttgactaaaactatagtttctatccatctaggatactttcacactgtttcctttatttcaaacatatccttaataaacacaaaaatacgtaatactcctctataatctaaaattaaaaaaatacatatataatagaatagctacacctatatttctatccatctaatatagttaatttgatagtttttctttagtttcaaacacatccttaataaacataaaataaataatataatagaatagttaaattattattttgatcgccctataaatcataatctaatattttgatgtctatttttttcaccatattagttttcttattttataaaattcacaattttaatttaatcttaattttgcacacttttttttacattttaactaacattgaggattgaaaattaaacatttaacaaactaaaaactaatttaattaattaaaacaaaaaagtgtataaaattaaagattatattaaaactgtgaatttatttaaaataaatgaattaaaattgcgagagtgagaatataagagccaaaattatacaaataaaacattaattaagctgtaaataaaataacaactaccttccattgccgtgataatcacaacgttttaaaatatatatattatttcacgctcaacccaattttgaaatgaaataacagaaaatttacctgttacatagataactctttgtaccattaaaactgtcgatctcacagacacccttcccacgccactttgaagggacaggtccgtatcctttgtcgcggaaactcgggtgttcgggccaaacccctgttcaagaagcaactaacgtatttacaaaaggaaaatatgtttggaagaaaaaaatgtaaactgaatttagagcacgtggaacagtagtcaaaaagagattaactaagcatacctgtatcaatattagcgatgattatattttctccaaatcttgctttcctccaagcggagtttgcaggaatttttccatttttttccagtccaagaaaatcccatgacctggtagtgaacaatttgtgctctttgctcaagaaaatagaaactacatttggattttctgtaccaatagaaacatttaatacattattatatcaatttgtggggcttcaagatgacaagaaaatcatggcaatatatggtaataaagtttgctcacttgcaatctgtgatgcttcttcctcttcaagtagggcagcaaagccattgatgtgcttattgtacgagtacataattgcttccttggccctctcatgactgttaaattatcaagttttaattaacacgcacgtcctaataatatttaacataatttaacatttgtgttaccttcctaagtaagaagcgagtaaatcatgatgggagtttgtggctgtttcaagatcacttggcaaagggtctggaccatgagaatgtcctcccatgtacacaatgtaggtctgaaaacacagaaattcaaagcacacaattggtgaaatgttttatggtacattaattaacaaaatataaatttggaaattctcaaagttggaacttgaagagatgatggcaaaactccatcagattctttattgaaaaccgtaacgggggaactaaaaggcaaaagctagctaactagcctttctaagggcattggtagtttcctgcaagaaaatgcagagaaggaagaatgacagaacatgtttgaagatggagaatgccataatatatcttcagttgttgttttggtgtggatgtaatccatggctgtgccactacttatatatatattccatcttaattttattctattcttttctttctctcttcattgttcattagctattatatattatttagtatatctatcattctctttcttttatttttttctctctattattttgagttgttttgtgctcataatgagatagttagcatttttaagaataaaaatttattatcaagaactcaatataaaaagagataaagacatatcaaaatttatctaaaaaaaagttagttaaataagatttaataaaataagatataaatttatagatatcatcatgttttattgatctctttttagtcatttttttatttattttctcctccttttattattttttctaatttttttatttatcataaaatttatctatcatatactccaattaacttagattaaaaatgatgtaaatattgattatttttttaagtcatacacaccactaaaaaaaacagagtatgcggttatcatcgctccatattataactccgctttcaccattttctagaagcatgattttaatatgaaaaatgaatgatatccgaaaggtatatatacttgctgattgataaatatatcatcctaccaaaagttgaaaaatatagtaaataatgtgatataataaaaatataataagacgcaaagaatgtatatattatgaaggtctttgcgcataatgctttactattggctttcgaaatttgcctacgccctcttccaccaatcaccatatgtcattgactaaaaaaaagtctttcactccataagggtccgcttggaaggaacacaaataaaagaagaaaaaaaaccatgtatttctcttatttggtttgagaaaaaatataaaaaaatcaagagagtaacccacttttagaaaggaaaaaaatttacaacttttctatttttaattttttctccaatttaattttttttttcttttattttttcctcttccaaacatagggtaagtctagctctgtatcttacgtaactttcacctattttcattacatagacaccagtgacatcatcaattttattaattattacttattgcaaattgcaacagcaccaccgacaattttgataaaagatcctgcttacagctcttccaacatattgtggccctgtagaagacgcaggtcgacagcataaattattcggattagggctaggcttcctatcattttttacgttattttcaatttctacgtaaatactatctttctaccaaatataaatactgtctttctgtataagccaaacaatccagtggcattagtttgtaacaatagaaagaggaggagtatcaaacatggggaagtgaataactttctcagcaatgggtaagttacataatagatttattgatttgataattttttttgatcgtatatttatttgataatttaatggttaagatagtagtcactaacctgttgtaaagattttaagcagaagtttatgtaattacaaacagtgcatgaattttatatttaaagcagttttgttaaattatataacaattaataatttacgagaaaaagtagttctcgatcacgtgaaacattccaggccacttaattttagtacagacgttgcataaagtgccttcttttcataaaatatttcaaatcaataactttttaataaaaaaggtaaaaaataaaagaaagaaagaaagaaagaaaaatccctgtttgattaatcaaccaaagatataggtatcaaaataaatagaaaaaaacaaagataaaacaaaggaattaaagtgcacaaagttcgagattagaattagttaaagtgcacaaagttcgagattagaaaggcaattttaattattttttatgatgtatttgatttagaagatcagaataaagagaatagaaataaaataatttttttaaaattaaaataaaatataaaatgaatgagtttccctaaaagaatttacaatttctctttaatattatttttaaacatattcttaattttctcatacaacacacaataccaaaagtcataccaaacataagtttaagaaatattttattgacatagatttagactaaaatattttcaattttcaactacaattatcacaaattattctataaatcatactttttcaattattcacaataataaataaaagtaagaactgattacgagttacgactactccttccgtaccaaattgattaatgttttagcgtcataagaaattctatattgaccaattttaattctgtcatctaattaataaatattattatcttgacacacttaataatatatttattgaaataaaaaataaaaaatattataataaaattgtttcctaataaattttattttcatgattagcgtctcttttgaatacaaatattaatttatcctcttgatgataaaattgagaaaaaaaggttaataataaacttgtaagtttatttatttttcgtaagttatgaaaaatttaatttaaataacttatgaaaaataagttactttaacttacaaaaataaattacttgaggtaagtttgtgtatgtaccaattacaagctttaaagtaacttataaactagtaaaaaattataaattttttcaagaatcttaccaaacataagatctcgttaaaaaaatatcataaaaaagttaaaagaatcaaaattttgatacaaaaccaaaagactaaaaaaagtattactttggaatttagagggtatttttactttacttttactaaaagaaattaaataattctcaccataaaattaattcaaacacacgatactcatgtccgcgtagaattctattgattaaccatataaaaatctggtagatcaaaattaaaatatgtatacattatatattttgcttaattataatttttttgagttaaaaataatttaattttatctcaaattcatttattttttttgctaaacacactatacttttttctttttcgtgaccaccaccactgctacctaccataacaacagagaatatatgaatgcttgacctctcttcctacgagccttctccatctccaataacaatcacagccaatttatgtattgtctctgttttttaggagagaaaagataaagttattccaaagataatcataagtcaatgactaattgactatggccacatcaccgttcaaaaaagaggaattttgctaagttgattttcaatataagatgtttgatgaattttttaagataaaaaataatttcttattttttgtagttagagaaaatccaattaatattgtagattttttaaatttaaatctaagtattttatataaataatttatgttacaaattcttaaaaataaaaaataattaaatatgctctaagtttctcttccatattcactcgggtaacgaaaatgctgcatgttttagccactttgttcatgtacgtgggggaataagactttttttttttttggtggaaaaagattaggctccgtaaaaagcgaaacagggcaacagccatctattaaagcacctccaagtccatcggatccgaggtggctgatgtggtgaaacttaaaaaggaacaggttcttggtaaatattcttaaatttactaggaacactatatatttgcagtgaatatttaaaattgtattgctgaagagaagatagtggacatttaataactaaatgacaaactttaacatgaattaagaataaaattcagttacattacaatctagaattatatgaaaagaaaaagaaacaagtaaaagggtagaaattatccctttctttataaattggagatgaataaaaaaaattcttccaagaccttacattgtcaagccttagccctttattcttgttcagggttttctacgtatgtccctctcagtttattatgaaaaaaaatcataggcttaaatacttgtttggtatttataatttagttattttttcatttttatattggtatttttttttgttttagtccttttaaagtatgtttattttatctttcttctttaaaatgctttagattgtaatttgaacaataaaataaatattttgaacaataaaaaaatattatttaaaacgttttaagaaaaaatattttataaaaaatcatttttttacaagaacgaaaaagaaaaaaaataaattataaaaacagttgacatattttataatataaatgatatgttgagatgctaatgactaatttaaaataaattatctttcttcactttaagaaaagtgcattatcactataaaaaaagttgcctagcaataaaagaaactcagaataaagtaaggaaaagtgtgtttggaaacgagagaaaggcagtataggtgtttttcttccctttgtctcaaacttgatacttttatcattattattattaggataaataattatttttatttttgaatgtgtggaacacggataaatttgtctataaaaaatgaaaattttaattttaatttctgaaaatgaaaaaaatgtgacaaatttatcaatatgttaattttcatctattatcgttaatgaatgagattatatgttacatttaggaaaaaatttgtcaatattttacattatgaaagggactatttatccaaaatataatttaatattcatctttctctcttttttaatcattgtaaacataatattataatacttaaaaaaatagaaaaataaacataaattagaacaaatataataataaatataatatttattaataaatataatatttattaataaatataattattcattaatctgaaaattctaatgagaatcaaacaaaaatattaagttaatccttatatgtatcatccccttgaccccatatatattccatttctaactcaggcaacaacgtaaataatttcatgttacaatgcatgattatatatatatatatatatatatatatatatatatatatatatatgtttgaatccagaaacaaccagcgtcgaaggggccaaagtttcacgtgaaatttaaatgtacaaattcgttaaattgtatagtgcggaccgcaatatatatgcatgatgtatttttggacattctgccacaaaatttgtcgacagggtatctaacattttagaattttgctagctcattcctctctcaagaaacaaagtactaactacatggcacattagtcccaatttctacatggtatctgctagcatcaaataagttttttcaatgcatgaatcattaaatcaaagaatcttgttaatttgatggttgaaaactattaatattttatgcagtaattaatgtattttcagactaaagtacaaccacctataccttttggagtgtcttaagctttgtatttatgttggacaggtggctcattaacctgttaggtagtagaaatctgctgtgctgttttgtcagtcagtatatggatcagaaacataacattttgctgctgtatgaatgaaatacctctcacggttcttatttcatagaaacttcttgtaccagcaaaactattatgttacatacctctgtaactagtttttgtaaaaagcagtagattccgcaataatcaattaccatttaacataattggttgctttgcttggatactagtttctaaatactagttcagtaataattgattacttgtcatattaattgattacattgatctgaatgtgaaccaagatgttttcattgttttgttggatagtttaattgataattgtatttttagtctctcagtttttgtagtttaaatttcaatggcatcaattgataattgctagcatttcgcttaacggaattagcagatgtgacaaacagacatgatatcagtaagtaaatagagttttaagatgtcatgtcagtatgtcacattagctaattttgttaaatattagatagaatgaggatagaggaacctcatgataaatgagataaaattcaaatcacacacttgtgacatctgaggaactaaaaatgcaaaataaaaaatctgttataaatgttgaaaaaaaaaaaattgcactttaaattctggaaaagaaattctgatagaaattatgctattcctgtagctaccacacaagataacaacaacctaccaattcgggacgcctttgatcagatagcaactccatttgattatggctctggacatattcagcctaaccttgctatggaccctggacttgtttatgatatgagaacaagggattacttgaacttcatgtttaagataaactaactaaaagataatcctaattctaattgatcagctcatctggtagtccttgaagtgcatgggtgttttggtgtccctcttgggcattgtgtatgtttgggctgcaacaaattccaggtcgaataaacatatgactagtttacttcttataaggcttagacagtctctagcttacagtttaattttgtgagatcctgataggtcttaaacctaaattttaaaatagctatagagcatatcataaatctgttattgggcatttgggtcacccaattgaggtcttacaaagctttggcattcctcaccttacagttttgtggggttaagatcaaattctatgataattaaacccctaatttaggttttttctagctactttcatgttgtcaccttgtattatttttcaaaattataggaagtgctagtgtactactggtattgctttcagtgcgagtgatttaattatctattgttattgactttttaagtcagcaaattgttatccattgtatataacagtgatccatgcatccagcggatctttgtgatgtattttgctgggcctttgtttcttattttgcagcaaatctgtttaatatttactttaggattgcagaagcagaacatagtctctgtattattttcgtttgttgaataagtctttcaagtcagtaattgttttttaatttgggaaaatgtttttaatttcctttttttttgtagattaagattactgggatattgaaaagttgtaatttttatgtttattacgagtggtaaaaatgttggctgatagtaaataaagtagaattcctacatatctaaattgtaaatgttggctctcaacctttcttctgaaaaacctaccgagtttcagaatttatcaaatttcatgatctttagacatttcctttgtgcggcatacaatgatgcaagtttatgtagagctaagtttattttcttttctaaatgtatgctatatacaatgatgcagttaatctgattaaccaacctttttgacttggcctccttatgataaaccgtaacaaccttatcatcagctttcttatcaaaatatttttttaatattctgcccattgataccagaaacatcttgtttgggctttatgtgatttattttgctccattttgctgctgaactttttttttttttttctcttcttagaattaagagctgctgaacttacttcagtcatatttgcctattcaaatttgaccttttggtttgggctactaaaagttcaaatttaggttccaacaattatacatgaagtaagattagtactatgaaaattttaatatatatttttaatatatttatatattaatatagattattaatctaatattttaatttgtaaatacatcgtgtaaacaccaattaaatagacattactcaatgaagttaaatataaatttattatattatttagcttatattattgtaacatttgtttcctgtaatataattttattatttagaatttctcattacttacatttatgctgcaattactatataatatatattaagttgtattaatattttaaagtataatgattatattgaacattagagaatcattttaatatttaaaaatacatgcatcgtgaattttatatataatatagatataattatttttcaaaaccaaacttgtcggcctggtcaccacgctagaaataagaacatcatcgtctgaaatacattaacttgggcattcctttttttattattattattatttgtctttttaaaagtgaataaaaatttaaaatgatataaaaaaagagtgaaagtaagtaaagggtgcaatcaatactctttcctttctcactttacacttagtctacttataaaagctgaatgcatgatcaatcttagtcttccactatgtatatcttgaagaccttaattagtcttccactattatcttgaagtctttgttggttttatttttgtaaccaaccttaattggttaactatacctatgggtagtcataactatttcttatgaatagtcataactattcctatagttaactactgtaatattcctgagtcccagcgcgtttggcgcgagtttgggcgcgtttagcgcgagtttgaggcttttggagggagattatgcagaaaaaaccctcagcagtttgtttctgcataatctggcgcggccagtgccaggtacggcgcggttagcgccaagggccagaagtgcggcgctgatggcgccatagtggcgctcatggcgccacatcttctgcaggttggcgcctggggcgccaggggtggcgctggaggcgccagacccctctgagttttccagctggcgcggttggcgccaagtgtggcgcgggtagcgccagagtttctggaggttgacgctcagggcgcgggaggttcacgcctgtggcgtgggaacttctggaggttggcgctcttggcgcgggggttggcgctcttggcgccagaggttctggaggccggcgctgttggcgccggagttggcgctgctggcgccgtgattttgcagctggcgcgatcagcgtcggacatgacgcgatccgcgcggcagctcggacagacccactataaaaggcctagggtcgcgtttggggtccaaaaacactctcctcttcttcctcagacctcccacctccattgttgagtgcccaagcttcattccttcaccattcttcaccaaaaacacttccttaagcttgttttgtgatggaaatcactcctagagcttgaatccatcctccattcatcttaaaacccactcattttgaggatccctttctcaagggaagttcgtggaactcgagctcggcgaggaacgacgacgattcgtgagtacccaagctaggggaagtcgtccttgggccttccttgcgtctattgaggtaagaaactcgagaatcatcccttgatttgtgagttggggttttgggtgaatagtgacccacttttgatagagctagttttagccttgggtcatgttgaagcatgtgtttggaatgttgagaggatgtaggattagctcttagaagtgaatttggtgaatgttggttccatggctctttgtgaagcatgtgtgtgttgttgggctgagttgcttagccattgttggacatgctagagccttggattgtggtttggatagccttgtgaggctattgttatgatggcttgtgtatgccaagctttgttgaaccataggttagatgacttgtggtttgggaaggattgtgagtcctttcgttgtgcgcggttgtgaaccgcatttgtttatgccttgtgaggctcgttgttgatatatgcttgtgtatgtgccttgatagggcgtgacaccgcgggtgtcggtggcgtgggccacggagagagggaagaactgcgaagctcggctttgccaggtaagttcttggacccttggggatgtttcccattgcttgtgctctaccatactccgagggagtagtggtttcattcatgactcatgcattgtgtttgttgcatgctcatatatgtacatttgcttgtagctgtgcttgatattgtattaagcctgtgattagatcttctggccagtaagatatatatggacctccctaggagagagcgcaactcctagtttggctggctctggttgactcggtcccgggatgcggagattccctgaggccaagagctaggatgtgtaccgttgcggtctgcctagtctcggaggtaccatatgcgtgcatccatgcgtaaagaggtagcacccgatgggatggcacgggtgtgaattccggcttcacactgaggtaggcgttgactcggtccgccgtacatagagcaccgggttggcatgctttgtatttgtatgagaggccgggatggcccagtgttgtgatatcatgatgttgcgtcatgatgagtgagccagggtggaggagatgcctccaaggaccctgagcttactgagatgtttatctcaccccgtgtggggcttatgttttcaggtgatgcttctggtagaggggagcagtctcagggcgggaggccccagtagagacggtaccagcttggccttgggcagctgtggatcgcttggagctcggctcagcatctgtttatgttttgatgtacccctgttgagggaagacatgtgttgcacatgtgttttgagttgtattttgctcagttgatgtaggccctcttttggaggaagaacccttggggttagaagcactcggatgctattctttgtatgcacctcgggtgccagatgttgtatataactcagttattgtatatgatgtggtttcctcctgtttatatatctttgagatatctgttatctgcctatggttggtttgtttgatctggttaagcaggggcatgttgatgcttgttgtgggttgtgattccatacataatgttatcgagaaaatatggttttcggtttatgcttccgcagtaaacatattttacggttttaattaactatgattaagcgctaatctgatgattatataatgataatacgccgggtatacacggggtgttacaactacctttatctcaaccgctgttaaccgctgttaacttcccatcataaccatacatacataactacctttgatggaaaggtctatatataggtgtgtatcttcaatttctggggtccctgaactcactcacatataaagtgcatatacatcatccagtgcaaattgagagagaagagtttggaagactcaagaaatcacttcacattgcaatattacaacccaattcaagaagcaatggcgggaggtatttatattctatttcattccgcattgatctaatattatttgtgaaaatgattagatcattaagtatatagaaaaattctaacatttggtatcagagccaggttcaacctctgccttgtttttacgttttgggttttactggatattttgatttaaagtcaataaagtttaattttaagaatcataaagaaaataaatttctaatgattctggactttaaatcatgaaaaacggtataaaattttatgaagtgtgtgtcattttattaagttttaaaacgacaattttgcgtgcttctatatccttttgcttaatgttgaagacaacttaagtttgtgtcgttttattaagtttcaaaacgacaattcctttgattttgatattatcaagataaggtgcatgttcttgtacttttactctgaaaaataaaagcaagttcttattttcaatgcttttatgctgcaagaaatgctatgttgtcatcttatgctttataaatccatatcaaagataaaatattaaattatattattgagttatccataggaatggaaaatataatttgatagttttatcataaagtatttataatcaataaataaatgtttagtgatctttataatttaattaattaaggtttagccacaacacccttagttaattaaattacaaattcagagcctctagatcacataaggaaaataacattaattgtaattagtcgtatgtaatatgataaatatcatctcacaagattatttatcatgtttttgtatgattaattaggataaaaatattaatttatgttcttgatttgcccacaggcattaagaaatataactgatatattttatcattaagttcatatgaattttattgaattaaaattttggcccacaggcaaattttatgtcactaaattcataattcttttagcatgttttacattggtaaagcatgataatgatttatttttgtctcaaattttaagaataagcatatattttgcaattgtacaacctgttagttctattgaagttcctgaattgagagggggcaattacccaatttggaaggagagaattctcctaaatttaggatatatggacattgatgaagctatcagaaaacctgaaccaccagttattattgagaacagtgaactagatgaggtggatcgttttgaaaaatgggaaagatccaaccgtctgtgtgtcatgttcattaagaataagatctctgctggtattaggggctcaatggaaaagcataacaatgccaaagtgctcatgaagtctattgatgagcaaattgagatttcaggaaaagcactggctagtactctaataatgagattttcatcaatgaagttcactgctttaaggggtgtgcgtgagcacattatgcagatgagggacattacggcccaattgaaaactttggaggtggatatgtctgacacttttcttgtccattttatattgaacactctcttagcaccatatggtcccttcaaaatatcctataacacgcataaggacaaatggtctattaatgagcccatgaccatgtgtgttcaagaggagggaaggttgcaattagaacaaggagagagttctctactaacaattgagaaaagtgacaagaaaataaaatataagaacaagggaactggtaaaataccaccccaggctggaattaagaaggaatcatccaggtgttttttctgtaaaaagaaagggcacatgaagaaaaattgttctaagttcaaacaatggtttgaaaagaaagatatgcctacctctttagtctgttatgaatctaatatgattaacataaatcataacacatgatggattgactctggttctacaatctatgtttcaaataccttacagtgtatgcaaaacttaaggaatctagtgggcagtgaactgtacatctattcaggcaacaagatgagttcacctgtggaggccattggaacctgcagtttagttttaagaagtggttttattttgaatttggaaaagactttttatgttactagtttttctaagaatttaatttcaatttcaagacttataccatttggttattctttttcatttcatgagatatctttcagtttattttataattctgatctcataggaaatggtattttatgtgatggtcttttctatattaatttgcaaaatgataccacttatgacgctatgcatgttaatgttggcattaagcgatgtgttatgaatgaggattcctctatgttgtggcaccggagattaggacacatctccattcagagaattaaaagattagtgaatgatggagtacttagtactttaaatttcactgattttgagacttgtaataaattgcattaagggaaagcacaaacaagtctaaaaagggtgccaagaggagtaataaattattagagattatacatacagatatctgttgtcctgatatggatatatatggtcagaaatacttcatctcttttatagatgattattcatgatacatgtatctctacatgcttaataataagtatgaagccttagatgcttttaaggtatttaagtatgaggtagagaatcaatgcggtaagcaaattaagatcgtgagatcagatagaggtggagaatactatggtagatacactgaagatggacaagcacctggtccatttgcgaggtttcttgaagagcatgtgattgttgcccaatacactatgtctggttctccgaatcagaattgtgtagcagaaagaagaaatcgaacattattggatatggtgcgaagtatgctcagtagttccaagcttcctaagttcttgtggaaagagacacttaagacagcagtgtacatattaaaccgagttccaactaaggctgttccaaaaacgccatttgagttatttaaaggttggaaactgaatttacgacatgtacgcgtttggggatgcccgaagttagaatttataacccacaagaaaagaaacttgacccgaggactattagtgggcatttcattggatatgctgaaaggtctaagggatataaattttattgtccatctcacaacactaggattgtggaatcaagaaatgctaaatttcatgagaatgacttgattagtgggagcgatcaatacagagactttatttctgagaaggatcattcagttgctcaaccatccacttcaaacgcaagattgattgttatccaaaatacccctccagttcaaccgggtgttatacaactaatcattgagaatccacaatctgttactgatattaatctagtagatcaagttgttaacgaggaacaagaaattgttgatcaaccaattgagcaacaagttcatcaagataatcgtgatataacattaaggaaatctactagaataaggaaatcagcaatacctagtgattatgttgtgtatttgcaagagtctgattataacataggagctgcaaatgatcctgaaacgttttcgcaagccatgagttctaaggaatcaaacttgtggtatgatgctatgaaagatgagatgaattctatggcatttaatggagtctgggatcttgttcagttacctgatggtgcaaaagccattggatgtaaatgggtctttaaaactaagaaagacttgtcaggtaacattgagagatataaagctagactcgtagctaaaggatttaatcaaaaggaaggtatcgattataaggagacattttctcctgtgtcgaagaaagattccctttgtatcatcttagcattggttgcacattttgacttagagttgcaacaaaaggatgtgaaaacagtctttctcaatcgaaatctagagaaagaggtttatatgaaacaaccagaaggatttttctctagtaacaatgagaaattggtgtgtaagcttaagaagtctatatatggattgaaacaggcctcccgtcaatggtatttgaagtttcatgatgttatttcctcatttggttttgtggaaaatattatggatcaatgtatataccagaaggttagtgggagccaaatctgttttcttattctctatgtggatgacattttatgatctttataatttaattgattaaagtctagccacagtaactttaattatttaaattatattaagactctttagaccacataagaaaattatgagataccttcaagggactaaagattacatgcttatgtatagacgaactgacaatttggaagtgattaactactctgattcagactacgctggttgcattgattcgagaaaatctacttcaggatatatatttatactagccagcggagctgtctcttggagaagtgtcaagcaaccttgactgctacttccactatggaggctgagttcgtttcttgttttgaggctaccttacatggtgtatggataaggagtttcatttcagggcttagaattatggattccatttctaagtcattgaagaaatactatgataattcagatgttgtttatatgactatggctaagaataacaaaagttgtggtcgaagcaaggacatcgacattaagtatctagccataagataatgtgctaaagataatacagtggttattgagcacattagcactgaattaatgattgttgatcctttaactaagggcatgccaccatttaaatttaaggatcataatgatattgttttgataaaactctattgtgatgttttcattcagattatgcgcatctaaagttattcattttgagaaacatcaataaagtttggacctagaataaacgttgggtttattcattaagttatatgagattgaaaaatataatgcaatgtgatacatggaagataatactcgcatacattagaggacctatcaccatgattaatgtattttatttctcattatgtaaaggatgggatatgttaaccaagtgggagaatgttggttttatttttgtaaccaaccttaattggttaactatacctatgggtagtcataactatttcttatgaatagtcataactattcctatagttaactacctttatctcaaccgctgttaaccgctgttaacttcccatcataaccatacacacataactacctttgatggaaaggtctatatataggtgtgtatcttcaatttctggggtccctgaactcactcacatataaagtgcatatacaccatccagtgcaaattgagagagaagagtttggaagactcaagaaatcacttcacattgcaatattacaacccaattcaagaagcaatgacgggaggtatttatattctatttcattccgcattgatctaatattatttatgaaaatgattagatcattaagtatatagaaaaattctaacaatcttaactcaagaatgtttacattctggataagaataggcttttatattagcgaataagaggaggctctccaaaaggaaaaattttcaaactcttactataaaatggtattcaaggttttaaaaagtggtatccaatgagaatttctgctgcagtataaaatcaacgcagccacatcagttacatttatctgaaattttccacaacatcaaatactgcaatgaaactctaacgggacctgaccgtaatttaaaaccttggttgcatacaaccagtgcatacaaggcagcatgactaagcacatgccagttatttacaatgaaagtgcctaatactttaacccagtccatcagttcagatagtcatgtgactttagattcatttgtgtctcctcaagcagtatgcatattattgttaaatggtgttattttataggtcaaatttttaccatcaaaccaatcaattgcaatttggttcaatttggatgagtttgagataataatcacactacattccaacggttgaaaataagaaggggctagatgattttcaatcaatccaacagcacttcaactacttaattacattcatattggagttggaagagtgatctaactgattggaatcaaggaagcaagcatgcgttgaagtaatgcatttgatttagcctattttactttaagtttttcaggaattatttcaaaaaaaataaaatgaagaagactacttttaaaaaaaacaaacagttagcttttcaggaattattttgaaagtagattttagactactttagtttatacagtcaatagtcaaccaagtaaaccctatcactctttttctatagcgaacatataatttccttatctatttattattttcttaaaaaaatattatcaacgattgtgttacgtaataaactttagattaatacagcttttcatcttaattttttaaaaaacttattaatgatttttaacatcaaataataacaaaaaatatagtaatactttatttaccctatactaagtttaattacagtatctttttacttgatttaatttgactgattttttcatttgttaaatttcgtttaattgtatttatgaaattcatagtaattatttgaagaaaaaatattttaatcaattaaaattaatttgatttaattaattatttaattgattaaaatttctttcaaatatgagtcacaaatgttttcatttttttttctatttgaaataaatttaatccatgtatgctataattttgtgtaaattatataacatagatagtcattttttttatttgtagaaattaaagatagtatcaagaaatttacaacaattcatacaccatgtgttaattgagctaaatttctttgatatatatatatatatatatatatatatatatatatattgctgttttacaaaaccaatgaaatattaaatttattttcttttccaagaagtactcttagagtgcatttatgtttgttccacgaaataaaagtttattctcaagaatgctacataatatattttaaaaaatttgaaatattaattacatatctttaatagttgtgttaaaactataaaaaataattgtgtttaaaagttatctaaatcacaatggagagagtatttatcattctatttagtaaaagttttttatttctatagagttcaaatgattcttttcctaaccatgaaccattgagtctggcatggttagggtagcattggggggagtagagcagagcagttgaatctcaaggtactccttcctccctatggtatcctcccgatgtgaacaattcttaatttaaataaaccatcaaaataagtattgacatatatatatatatatatatatatatatatatatatatatataacaagattattgattttatgtaattatttcttttaatatttaaaacaattgaaacaactatacacagtacacaataacgctactccaaatgatctgatgcggtggtaatacaaatctggtacatccaaactaaactatgtaatatgccaaatattatttaatgctcaaatagttttttattattgaaaaattcatcaattttgtatttgatccttaataaaaacaaaaacttttgatccttaaaaaatattttattttatatttaatctctgttgttatattgattttgttaatttgagatgtcaccaattgatggaaaacattttaggggccaaaagacaaataaaaaacatatttcaaggagcacttaacaaaaccaatgtaatggtaggaaaaaaatacaaaataaaaaaattcaagggaccaaatataaaatttgtctatttttcaatgacaatagtaaaaaaaaatttattaaggactagctgcaaaattcataagtttctcataagaaaaaaacatttctttaagcttttattttatctcaaatttattttcttttgttaaacgtactttctctctttttctgttagtggctttacgggacactgtaccatcccctccttccccaccactactactaccatagagaagtcaaaattacaaggaagccaaaaacacaaagaaggatcttgaaactagaagcatactcttacaccgttgatgcaacttgatggtaatggagccgagaatttacccccttttttttttaccaaattaaatgattttgaaaattatatgataaatgattagcggataaattcatagcaaacgttaaagtattaaattgagagggaggaggctctccaaacataaaactttgtcaaacaaagctctataatgattagtgaatgcgtctattaaaaaaacaaaaaaaggtgcctgtcacaattcccataaaataatgcaaatccagaagtgaaactcaccaaagtctatcctagcttagtgaaacatcgcatccatatcatccccttcaatcttcatcttcccattatttctagctctcaggcaataatatcatcttgtttattttggaacagggacgtctaggtccgactcctctttcagttgtaatcgcaaattgcttctggtttagataaataaggtccaaaattcagcttatacttcaacatcattatcttatttgtttgcgacggattttttatgttagtgaccgattatttacttcagaaattcccatttctttagtggtttgaagaaaaatagtgtgggttaaaagagaaaagagataggtaaaatagaaatactaaattaatactatttatttaagtggaaaaataaaaaggagataaggacgtgaacttaaagcaaagacgcctgtgttgaaataatgcatttgattaggcaattaaggtctttgattttttgtataatgcccttttggctgaaagttgtaatactgtgttttgttgcggattttagtgttcttgggattttttccaattttttcaaaaaaaaaaatattgcatctgatttagcctattttaaattttttttggggaattatttatctttaaaaaataaagacaattgctttagaaaaaatatccctgatcaaaccactttgctttaaaaataaataaataaaatgaaattagatataaaataaacaagaatgaagcctcatatagtattgaacataattaagccatatattgaatagaaataatattaaaataaatatataaggggagaagaattttcactttacaagtcatcattatatgattaagttaaacttaaacccatatttaaagataatatggaaatctcttttaaggtcacaaatcaggttatctacacatcaaatctaaattttttttaggaagatgtataaatctaaatataaattttttgtgcaattaatgtatttgttattgttgagaaaaaatatcacattgattagagttgtacaaaatataaaatatataaatgaaaaataatcttataaattgatttggtaagatttagttaaatcaaaactcatattagctattctaatagtgtagaaatgtacattaggcatgtttaagctaaagaaatttacaaatggaattatattttccttagatggatccgttgaacaagacacaaaaaacttttagatagatttatccaaagacgacttcttctttcttttggtggacccaaaccaatgacttcctttcttttctttttttttttttttgtgaggaacgacttccttttgtaacaaccgtgagatggcatctatactagggtagggatagtattatttttttttcacatacactaagaaaaataatcactccaatatcatagtatttattagaaatcaattttactaaaatatttttattgttttcttatttttacaaatatattaatcagaaatatgtttgtagtctcttaaatatattaatttcttatattttataataatgaataaaacttttaattttgaagcaatcaaactacttaatttaatttaattaatttctcattttatgcaaatttcatataacatttatttattaaaattcataatacaacattatttataaaaataaatattttaatcaattgacatgtgatttaataaaatgtttaattgattaaacattgttgcatatatcagtcataaataatattaattttttctatttaaaaaaaaatatccgtataatagttttgtgcaaaatatataacatttgtattcaaatttattcttcaaaatatccttatacgagttttcttgtagattactaaagtcctaatatataatgggacttgggagtgtcttcaattaaatgcaatatacttcatcgagtggctaaccgttaacgccaaataattctcaaagaaatatacagtcaaaatatccttatcttacgaaaaacattacttttttcttttgataaagtagcttttatatttatttttatataaagtgactttatttattttataaagaccaaaaacatgactgtctcccttcaaaatcacactttatttattcgatcttacaaaagacataagcgactttccattattttccaagtctttaaagaacagaagaaacatacaaagcactccatcagaaacatacaaaacatgcaagagaaaaacattaatatcacgaaaagcttaattacagtgaacaccaaaagaactaaaaaacatacaacacaccagaaaacaagtttcaacactatttagatagttgaccaagtgtgatcatggggagtggatccaaagaagatggttttggcatcacaaactcgttatgcacttgttccatacttgggcgaaagcgtggattctcacttaggcaagcaaatgttaattttgcaatcaagatcacttcttcaacaattggcttcactggctgaggtagtcgctggtccaacacatgaattaatagcatattagatgcagatgatgaaaacaatgcagaaatgagatctcctggatgctttcccattattatttccaaacaaagcactccgaaactgaagacatcacatttctcattcacttccatagtataagcaagctctgtaatttatcaaaataataaaaatagtattataaaacaagtagcaggacttattattgaattgaaacaagtatatatataggattaaattcttaagaacaaaaatggcctaacctggtgcagaatatccatatgtgcctgcaaacgctgttatattttgtgaatcaggattcagaattttagctgttccgaagtcagagatgcgcgcttcataatccaaatctagaagaacattcttgcttgatatgtcacggtgaacaataggaggaaagcaaccatgatgcatatggtacaaagcacttgccacacctttaacaaccttcaccctcctttcccaatcaaacattgttgcacgtgtatcatcggttagtactttatccaagctaccaccctctatgaactcataaaccaaaaaggagaagcgtggatgtaaacaatatccaagtgacttcacaatgttacggtgcttgatttcggccaaggctttaacctcagttgaaaaagcttttgaatcgggtgtttcctcgttgggtgcagcatgaagttttttcacagcaagaatctgtcctgagtgtaatgttgccttatagacagatgcagttcccccttctccaatgagatatttgtcatcaaacctctctgtggcttccatgatatcttcatacactatttttccatcataactccaaagggaataatgatcctcacttttttcttctttatcctcctcctttttggcctttgttgctcttcggtagcaaatacataacgaaattccaaccaccaataataacagaaatagagcgccgaaagaaaggagtaatgccaacatgatgacatttcttttcattttaccatgaggtagggtgtggcaaggcaccaaaccggaggcatttccacacaagcctttattatttttcaatgcatcaaatgaagcattaagaaaggctggaatgttaggaattgaaccctccaattggttgttagatatgtcaacatttgccaagctattcttaaaatcaggaatggctccagagagattgttgtgcgagaggtttagcttttccaatctttgcatactcgcaagtgctgctggtatttctccatttagcaaattccaactaagatcaagatcttgaagagattgcaattcgttaaattcccaaggaatgctttcggtgaatttgttgttgctcaagttcaagttaagtaatttaagtaaagatcccacctgttttggaattgggccacctaagttatttgctgcaagctccaatttttcaaggctggacaaagcacctatttctgtaggaatgctacccaaaagttcattgtcgcctattgatagataaagcaaagaggtcaacttcccaagttcttttggaatttttcctgttagatgatttgaagacaaaataaggctctgtaacttgggcgcctggccaagttctaggggtataccaccagataaattgttgttgcgcatcataaggcttgtgagattaggacactttgcccagtttggtgaaatgtggccatgaaaattattgctactcagatcaacgtagttcaactttggatatacaccaaaagcatcggatatatctccggtcatctggttttcatctagtctgagtctagtaagactggagcaatttttcaggcttgttggaactggacccgtgaaatgattattttcagcagtaaatatttgaagtagcccaccaaggcaaatttgttgtggcaaggggccagtgaaactattgtttgttagacgacagagcttcaaattggtaatgttattcaacgctggtggtaatctgccttcaagtttgttagcaaagacactgaaagcgtcgaggttggtcaaatttccaatggtggaaggaataattccagagatattgttctgataaaggacgaacaactttagattgaccaagtttccgatggaggtaggaattgatccagaaatcatgttcatctcaatgtccatgcggaccagctttgtcaagtttccaatattggaaggaattgaacctgaaattttattttcatcgatttgaaaaacagtcaaattgaccaagtctcctatggaggatggaatggagccagaaattctattggttgagagctgaaggaattctaaatttgtcaagtttgtaattgaagtggggattgtaccagagatagagttttgggacaattcaagtctaacaaggttggacaaccttccaattgttggaggaatggtaccagaaagtcgattcccttgaagtattagaagcttcaagttctgcaattctccaatctcctcaggaatagagcccgaaaggctattgtattccaagtttagaattgacaagctagccaacttcatcatggaaatggggattgagccactaaaattgttgtgactgatatccagagttagcaacttgggaaaggaagagaagttgagagtgtgaagagtaccttttagccccaaatttgtaacatttatggcagtcacagcgttggattcgttacaaacgattcctttccacctgcaaggactgacaacgccacttgtccatgaagacagagaagcttggctttggttgtcaaggctagctttccactcaagtagagcacttgcttccgtcccttcataagcagtgatggcagcaaagccaaaagatgaaaacgtgaaaacttgggagcaaaggaggcttaggagtgaacggagaattaaacgaattaatgaaggcttggtgaaaaccatgtttgaactattgggtgattatggtaacgtacaatatatgttggacgttcaaagctaccatgttccttcctatatatatcgtaagcttcaaaattttatgatttctagtaaatttttattaataaaaaaatatttaaaatagtacgatattagcatttttttatggttacaaaattaataatgtttaaaagtatattacataaatagaaaatatatttaagccaaaatatatatttatttttaagagcataattttcataccccgtaaatataatttttttatatcatattaatcaataaaatatcattctatatataatttttaaactaattgttataaaaaaattatcatatataataatatctatttatatatatgaatgacggtgtattttcattaaattttaataaaataatatcttaattcgtaatagattttaagttagattgacattaattataaatatatattttttaatctatcttaaattttttacaaataaatatatatatatgaacatttaagagtaaatataatatattttttcttatgaattgtgatactctaacgtgtctttttcgccatggcttatgcacgttttcggcgtgacatagtaatctctccgtcacaatttggaatctctttaagatagttttagtatcctctggacaaccaattcattaatataaagaaatttaacttatcttatcttaatactatataatctatattaacattatcaaataatttcatattatgtcccctcaattaagaggcaagctcataaatacatgtatataaaggattaatttttttaaaataacacattattttatttgctcatttactacattcattattttctgtgtcagaaatctaacttaaacatcaaagtacttttacatatatttcacccttcaaaggatagttttgtcatataataagaaaggacaccccaaaaagaatgaaacaacaagagaagagtcagtattcggccattttaaaacaggaacaattttagattttgattctaagatgttcaatctttacctccctaaggccttctcaatttgagcagacacaaaaggaacataggctatctctctaacgtttggtttctgtttaaaacaagcataaattacaaaaacgttcccaaagtttcgactttattatacgacatcctcattttttttaacgatactttcagccccatcctttaaacagcatgcagaatcaagatctgtcccgactttcagttgccgccgcagaggacgatagcgtgattgaaggaggagcggtcaccgctgcgccgccgtcagagtttcgcacgccgcaccccgggaatccagatatggttctcactccttcaaaaccgtgttgttgaagtttttcacagggtttcttttaattcttcaatgggttcttgaagtttttcaaattttattgttcttcaatagtttcgttattggcttgttgttgctgtttggttgtattcttattggtttatctgtggagtgcgagatatatagaagaatctaatacattgagaaactactgtgacgttagttttgtttgttcttgtaatttcacagaacaaatttccatttttgaagaatttatataggtattaaacttgccatcgtgagcggattgggaagcagatgtgtgtggaaaaaaaattatgtttttcattgcctatcttaatttgtttttaaaatttatattctaattttttcgtttatagttaagtgaactccagatcaaataaatggttgaagaagtaaatggtcatttttggacagtgcttcaatttcatgtgctggaaatcaatagcaaataaaggaaatggtcattttttaccctaaatgtgtatgataaatttgttctttataataattatggctaaaaaaaattaaaaattaataaaataatgttattttcactgtaactggcattccgagagtgggatctggcgctcagagcgtggcattgtagtagaaggctatttttcgcgatttttggcgtcatcagcgccagagtggcgccaggagcgccacagatgctggaaactggagccaagagcgccaaagtggcgccagatgcactggattttggcgccatcaacgccagagtggcacgattggcgcggcatgtcggtcaggccaagtataaaaggtcattcacgcgtttttaaaggccaaaaacactatttctcttcttccctgacccaggcagccattgttgcaccataaaagcttcataccttcatcacatcccattaaaacacctcttaatcacctctaatcttggattgaaccacttaggagccaagtttcagcctaacctttgagagaaacctcattccttgagtttcttcagagagctgagtgttggaagaggaaagaaggcagttcagggacaccggagttgggagaaagacttttccagccatcctcgaccgatttgaggtaataaactcaagttttaaccgtttaattgtgaaatgggtaatggggtgaatagtgactcatttgagataaggctggaattaggctcaggttctttcgaaaagtatattcaggaggttgttctgagagatatggaaccttgaaactggaattgtgatgaagtttgagtttgactctgggaggaaaaagagtgtgtgaatgggaggtactatgacttgtatgaacttaagtacctttacaagagttgttcgtaaggccaaatgaacgctgaaaacatgttgatatatctgttttggctgagttgaacaactagtgatttttagcattagtgaactttgaattgatttgtacagagtcttaaagaaactctaaggctttagttaggctaaagtagaccactgagggtcattgaattgcctagtagaagctgggctatgatgaaccttaaattagaagacagagattgatagagaaaggaagagtgtttcctttcatataaattgttgaaaaccgttactgatgatttgactcatgcctaatgtagggcgtgagattcaaactgctggtggtggtcaccacgagactaggagagctgattctgagctgagataaggtacgctcatcgttcttgggacatgtttcccctgcttgtgtttcactacacccagaatgggtgatgctttggtatgtattgtatgctgatgttgtatgatgctagaatactgagatatgcatgtaacgttgagaaaaatgccctgatggcatgttggcaattgaatgctagctacatcctgagatagtgtatgcttatattgtttacactgggatagtgtatgcttgtatggattatgagatggatgtgatgttcatgctatgtaatgtgaattgcatgagaaattctctggccagtagaatagggaactatggaccccttggaaatgtgcccttgattggatgatcttccttgggacaatccatagacgtccatgtaaatcctgggagaatgtgcccttcattggatgatcttcctcaggtattgggcggcaagtcctgagggaatgtgcttttagttagatggtcttcctcaagcatggatagggagagtcctaagtaaatgtgtctttcagtagatgatcttactcaggtactcagggagaagtcctgagggaatgtgtccttcagtggatgatttctctcaggcagaatggtgttgattgtatatggttagactgtgctgctatgtgcatgcagctcgttcatgtgagccgtgaaggctgactgtatgatggatgactatttgatatgattcctgttatgctatgttatgttatatatatatatatatatatatatatatatatatgtttggaaaggaaccagagggagggaaacctccaagaactctgagtttactgagatgattatctcacccctatttgggactcatgttgcaggaactgagacagaagttgctgtgagatcccaaggcaaaaggcctgagctgggatagtatggtggataaccctaggtttagatgactgagcttgttagctcacattttgttgacttttcatgtattttgtacccaggtaggagatatttgtatagttttgaggaaaatgtaccttgtataagacagagattcaccatatatgtatataatgtgtatttatacttgattaaggcttcctttattgtttatttctatgcttgctactctgatattatgataatgttaatacgccgggtgcacacgggatgttacattcttgaaaaatgaaaattcaaattttagtccttgaaagtgaaaacattgtgacaaatttattcattcattaacttccgtccgttactgttaatgaaaaactctacatgacacaaagatacgaaaatgtcacaaaaataattatcaatatggctgtataatatattgaatcaaaatgtcagtaaattttcatttgaccaaaatgtcattaatttttcattagacaaatttgttagatcccaaattttatttcattttagggaaaaatctaatttatgataaataatcatttttgtccctgaatgtgtagagcactaaaaaattgttctaagagatgaaaattcaaattttagtatattcatttataggcattgcaaaattattacaactatttgtttgtcttctcagatcattcgcacattgttggaaaataatagtatcatcagatatttttgtccaataaaaacttaatgtcttcatgacattttggtccaatggaaacttactaacattttgatccaatctatacaacaatcatgttggtaatcatttttgtgatattttcatccttgtgtgtcatgtaagctctttcactttcgagaactaaaatttgaatttttatctttgaaagacgaatttgtttgtactctatacatctagagatgaaaatgactatatacactaatacaatattatcaaatgtctgaaagtagtaaaattgattcatttaataccattaatataatattctaaagtagactaatataaattaaaacaaaatattttttaacgagatttactataattatctgaatcacaagtcacaactattttctacaaattaatttcatgcaaaaaaatttagtgaaacccgaattgttataaccaaatttgctgaaataaatgaacaaaatatgatttatttatattaaaaatatttgtaattttaacacttgaatttcaatattaacagtatttaaaatcaaattaagcaattctaaaatttttgaatgattttaatcggtttaatttgattttaattgaatctatagatttaaatatatgatccaatacatacataaacgattttaatgagttcaatttaattttgacctaaatacaaaataattaacctaaattatccaaattaatttgaatcaatttaaattcacatatgactcatagcagttaacaacaaccctaatcaagacattcttgaaacataatatcattaaaagcccgtgtgtcaatcacgtgtgcgcttctcttaacaagttaagaatcttttagggtgagggactgagggggtggctgctattatgagagtattaaatatttaaattagaggaatttctttaggacgaaaaaaataaatgaatacttaatataataagtcaaaactttaagggaagtatgtgtaatttacagaaaatttttcctttcgtacatagactaccaaattcataaaaaggaaaaagaaacaataatcttatgttatgtttgattggttgaaagggaaaaaaaatttaaaatttgaattagaaaaaaaaatgagagatgaaaaagtaaattttatattaaaaaataacattttttttcattttctctctacattaaaaaaatatattcaattatttatattttcttttctctcgtttctctactatcagaccaatcctttaaatatgccaaattagatgcacgcacaataatattgccctttaatcaccgcatcccgcagtcctaattacctctctaggacctatgatcatagatttaaactattgaaggccgtggcaagcgtggggcaccctctcaaggcccccacggtgggaaagaaagatggtccgtaagattggaactttttcgagatgcgtgcagttccacagtagaaatgtttccactggatttttttttttctaaactgcatattattgattgtgccttttattttttatttttgacaaagcacttgaatgcaacatgagcagaaaacacgcttatattacagcctgaaaaacaacaaaagcaaacaaagtaaaatgacaatgataacataacaatgctgagattaatttctaagagtccagcactacgataggactagttactctgtgcttgccatctgtccaagacaaattcccaaataaaggaatgttgtgaccaggcacaccaattgcctgaagaataacctgaaacttctttttttctccagttttcttaaaagtcaacgaacttggttgcacaagaaccttaatccccttcggccagtgagtattcacaacatacgtgcttggaggcccaacatttgtaactgtacgagtaacattaatagtctttgacccaggatgatgcaccgtaattgaaggatagttgaaatcttcaattctgtaagacttgggacaagtgtaatgggatttcactttgccaaaaaacttgagtaaagcttggttgtaaccagaagcacataggaagttcaagtaatcggttgtgcttaaatcataaacaagtccagggtgaattgcaaggttaggctgaatgtgtccggcgccgtattcgaagggagttgctttcttatcaaatgcattctgaatcggttgattcctattatctagtgttgtagctggaattaataaaaagcatagtaccgtgttaataagccgccaatgatttgctgtgcatgaagattttatattgatattactttggtaatgaacgcaccagtagtcataatagcagatttgatagctgctggagtccaattaggatgatatgttttgagaagacctgcaacgccagcaacatgaggacaagacatagaagttccctgttgcacggtgaaaagaacccgacgtctatctgttgcaagattagttggacccgcggcttgtgaaaaagcagcaattatgctcacaccaggagctgctatgtcaggctgaaaaaagaaacaagttacggttagccacaaattcatctctaatgaatcattaattgtaagaattaaaagttaatcatcatgtcatgttggtgtagttaacaaaatgtatatattatagacctttagtatcaatggttgcacggaactgggacccctggatgagaatccagctatgattggagctggctttactcctatatgtgtttctgcagcactcaggtaagctaaaatctccctgcaacaacatatatataaattaatattcaagtgcttcacttgctacaaatatactatatatatagaataccacgtttcaaagggatttaatgatatattaattttacttgttattgccattgttgcctgtacccttccacgtattattagtttcctttccacctatacttgcagctggtaaaatatgatcctcggccagaagtaaatttccacttccctcatcattttgcaccaaaactgtcacagcaccagcaagatgaccctgttggacctggctagctgaagttaacttattggctcgaaggcagactagtatttttccctttactttggtaggatcaagtgttcccggtttgcaaagacgactacaccaaccaatacatatatatacacaaacgtatgagacgaatatttgaaagcaagcttgggaaattaaaaaaaaaaaaaaaaaaagaatactgcttacgcatcatcaatggacacagtaggaagtctagcatcgacagaattaatcactggatagaactttttcgatggcgacgaagatggtaagcctttattgagactggcaccctgatatgatacatgtacgtacggtccaattatgtagacgttaagaaaattaaaaaaaaaaggttaaaatatgttttttttccaaatataaaaatatttgaaatttatttttattaaatttttaataaatttttctcctctcacaagattaaaatgtattattttttggtataaagataggctcagacatcggacttcatgtgaataacttttttacattcattaagtacacaaataattaaaaaatatgtcacattatacattaattatatacataaaaaatattacatttatattaattatatatatgactaatgtaaaaagtcatagtttagataaaaatcaatacatttcaaattttataagaataaaaaacatatagaaaatagaaaattttgtaaaaatgaatttcaaatatttttatatttatattaaaaagaaacatattttaaccgacaggaaataaaataatctctagataattagatgatatatcttaccgtaatggattgattgttgttgagagaaattttgctgataaattgtctgtcgattgtgctagcagcaacggtgaaggaccagggtgcaacatttgcgacacttaaaggcgatggtccatcatttccagcagagcaaacaacgactatgtttctggcaactgcatggaatgcccctatggacatcccatctgttaacaaagcttcgggatagggattagaataacccacggaggcagagatgatgtcaacgccatcataaatggcttgatcaaatgcttgtaccatgtctgcttcatagcaccctcctgcgtcgagtttattccagcatgctttgtaggctacaacacgagcttttggggagcctcccttagcagtaccattgccgttaccttcaacatttgcaccgcgaacaaaattaccaccagcagttgacagtgtgtgggtaccatgccctacgaagtcacgtccgctgcgtagccttcggtcaatcttctcatcttcggcctcccgattttttagaaaaattcttgctccgatcaacttcctgaatattcatcataattatattaatattaatattatggctacatgtgatagcaattagcagcgacgaattcaagaatttttcttgtcgtgagcaataaatagtttcaaatattttttcttaaaaaaatatcagagaaatttttataagatatataatgttatcaaaaaaataaatccaaaatacgtacttaaactctgtgtggatgtgtattagaagagctgaagactccaaaattgcttgcatgctattatgatactcatttatttattttggtcttgtgactcttggaaaaatgattgggtattattgtccctgtctgaatttggatttgaaatatggatttggagggcagagcatatatttttttattataaaaaaatggactttttcacataaaaccacaatagttgtgtaagagctttgtatattaacctgtcatctttattgcactttttgatagtaaaaagtagtgttcttatttgactaaaactatagtttgtatccatctaggatactttcacactctttccctttacttcaaacacatccttaataaacacaaaaataagtaatagaataattaaattataattttgattcatctataatctattttttttttaaaaatacatatataatatactaaatacacctatatttctatccatccagtattctagtatacttttgtagtttttctttcgtttcaaacacatccttaataaacacaaaatacataatataatagaataactaaattacaattttgatagcctatgaatcataatctaatattttgatctcaattttaatttcctattttataaaattcacaattttaatttaatcctaattttgcacactttttttttacattttaactaacattgaggattgaaaattaaacatttaacaacaaaaaactaatataattaattaaaacaaaaaagtgtataaaactaaagattagagtaaaattgtgaatttatttacaataaatgaattaaaattgcaagagagagaaaataagagccaaaattatacagataaaacattaattaagctataaataaaataataactaccttccattgccgtgatcatcacaccgttttaaaatacatatattatttcactctcaacccaacaattttgaattgaaataacagaaaatttacctgttacatagataactctttgtaccattaaaactgtcgatctcacagacacccttcccacgccactttgaagggacaggcccgtatcctttgtcgcggaaactggggtgttcgggccaaacccctgttcaagaagcaaccaacgtatttacaaaaggaaaatatgtttgcagtacaaattcatgaagaaaaaaaaaatgtaaactgaattaagagcacgtggaacggtagtcaaaaagagattaactaagcatatatacctgtatcaatattagcgatgattatattttctccaaatcttgctttcctccaagcggagtttgcaggaatttttccatttttttccagtccaagaaaatcccatgacctggtagtcatcaatttgtgctctttgctcaagaaaatagaaactacatttggattttctgtaccaatagaaacatgtaatacattattatatcaatgtgtggcttcaagatgacaagaaaatcatggcaatatatggtaattaagtttgctcacttgcaatctgtgatgcttcttcctcttcaagtagggcagcaaagccattgatgtgcttattgtacgagtacatcattgcttccttggccttctcatgactgttaaattatcaaatttcaattaacacgcacgtcctaataatatttaacagaattcaacgtgttttaccttcctaagtaagaagcgagtaaatcatgatgggaatttgtggctgtttctagatcagttggcaaagggtctggaccatgagaatgtcctcccatgtacacaatgtaggtctggaaacacagaattcaaagcacacaattggtgaaatgttttatggtacattaattaacaaaatataaatttggaaattctcaaagttggaacttgaagagatgatggaaaaactttcagattctttattcaaaatcgtaacgggggaactaaaaggcaaaagcttactagcctttctaagggcattggtaggttcctgcaagaaaatgaagagaaggaacaatgacagaacatgtttgaagatggagaatgccatgatatatcttcagttgttgtttcggtgtggatgtaatccatgcctgtgccactgcttatatatattccatcttaattttattctattcttttctttctctattcattgttcattagttattatatattatttattttttctctcaattattttgagttgttttgtgcttgtaacgatggtcagaacatttgaatgttcaacaataaaaatttcttatcaagagtttttttttatctaaaaacaattagttaattaaaatttaatggagtataatataaattcaggaagaatgatatatatatcttagaaattacaaaaaaaattagttatttatcattagttttatctgtcataaattttaattaatttggattaaaagtaatatagatgttgattatttttttattcatacacataactaaaaaaagagagtatgcggtaatatttttattcatacacatgactaaaaaaaagagagtgtgcggttattttttttattcatacacatgactaaaaaaaagagagtatgcggttatcatcgctccctaatataaccccgctttcaccattttctagaagcatgattttaatatgaaaaatgaatggtttacgaaaggtatatatacttacttatttgataaatatatcatcctaccaaataaagttgaaaatatagtaaatattgtgatgtaataaaaataaaaaaaataagacgcaaagaatgtatatatattataaaatttgatgaaggtctttgcgcataatgctttactgttggctttcgaaatttgcctacgccatcttccaccaatcaccatatgtcactcagaagaaaaagtctttcactccataaggtttgaggaaaaaaaacatgtataactctatatttctcttatttggtttgagaaaaaataaaaaataaatcaaagagagtaactcacctttagaaagaaaaaaattacaacttttctattttaaatttcttttccaatttaaattttgaagttttcttttctctcttttattttttcctcttccaaacatagggtaagtgaagctctgtattttacgtaactttgacctattttcattacatagacaccagtgacatcatcaattcctacctctgttattaattattacttattgcaaattgcaacagcaccaccgacaattttgataaagatcctgcttgtagctcttccaacatattgtagccctgtagaagacgcaggtcgacaacagaaattattttttaattttatttaaattaaataaaatattataaattaatttttattagtgaggtttaatttctattggtgatgataacagtcataattctgtttaaataaagaaaaaaagtttacatacagaatgaacgaagattgagtttgatttagtaatgcaaagacaattacatgacatattagcatttgttagaaataaatgtgcaataacaagactcaatcgattatgtaatcaattttaattttaataatagagtattattaaatttttattatcatactctactataaaacgttttgagtcatggattgtattgtacgagtgatataaattacatataaatatatgaatattatataatcaagtaattgaaaaaaaaattaaatttttttaatttgatgtttgatgaaaataatttttatcacattttatttattttttaccaaatgattaatcaatatttttttcttatgatgcatcgaaaagggttaaaaatatataaattttatataaattttatttgtcttgcatttaataaaatttaatgtgactaagttgtttgctttctcatgtaagaggttagaagttctatttctttcttttagttattattattattattattattattattctcgctcaacttttcaagggagtagtgcgttacaataagccacagcagagatgtgccgcacgaattgaaatcaataaaaaaatgttgacacgctttaattagaacattttttttattcaataataaatagaagagattaaattaaactaagtaaataaataaaataactaaattaataatttacgagaaaaaagtactgctggatcacgtgaaacactccagcccacttaattttaagcacaaacgttgcataaagtgccttcttttcataaatttcaaatcaaacactttttaataaaaaacgtataaaggaaaaagaaatatccctgtttgattaatcaaacaagacggcgtctacggtacgagagtgaaacatctctcgtacatgcgaaagaaaattttgatcgctggatcgattttaattttcatcaaacggttattattttttaaaattttaattttaatttttttctttctttgtttactttcctttctacctttttgtttttctctctctctcacttctctctccgcatttccatctccgcgtttcggcccattcctgtcgccgccgtcaccctctgccgcctcccaccccaccatcacaccgcatctcccaacattccaatgccactggcaaaaacgaaaaccgcaagcatgagataaaaaatgattggtgattttttgtggttcgcggtggttttgcggtcccgttccctccgtggatctctcttccccaaacccaaccttgtcttctccaccttattctttttttcaggaaggtagggacatggttgcatgcgccaaagcaggttcgctgatggagggtcgcgtggatcctagcggagctcaagctcctcaccatgcgtgtgggggagaccgccatggccgccgcggcgttcaatgacgttgtcgcttggatcctactctcccttactcgaagcttgatttgtcgtcggagctgggtcggagagtgaaaggaggaagcaaggacaaattgggtgttttcattttcatatttttgtcaatcagatatgctcgattactagatatgtttacgagtagttgattaatatatggatattttcaatttcattgttttttacttctttctttggatcattcatggatgtttaacaattgagtttctttgcggtaagagaggctaagagtcacggtggagaagtagtgggaagaagaagagacagagaagcacaaagggtgaaatcggaaaattagaaaataaaaaaaagaataaaaaatgattttaaaataaatttgatctaacggtgtataataattttcgtatgatacgagagacgttttccttacgcacgctaaactgcgtcatcaaacaaagacataggtatcaaaatagatagaaaaaaaaacaaagataaaacacaaaggaattaaagtgcacaaagttcgagattagaaatagttaaagtgcacaaagttcgagattggaaagataattttagttatttttatgatatatttgatttagaagatcagaataaaaagaatagaaataaaataactttttaaaaattaaaataaaaataaaataattgagtttccctaaaagaattcacagtttctctttaatattatttttaaacatattattaattttctcattcaacacaatacaaaaagtcataccaaacatacttttaagaaatattttatcgacatagattcagactaaaatatcttcaattttcaactgcaattatcacaaattattctataaatcacactttttcaattattataaaagaacgaactgattacgactactccttccgtaccaaattgattaatgttttagcgtcataagaaattctatgttgacccattttaattctgtcatcggattaataaatattattttcttgatacactcgatagtctatttattgaaaataaacaaattaaaatattataataatttcaagaatcttaccaaacataagatctcgtgaaaagaaatatcataaaaaagttaaaagaacgaaaattttgatacaaaaccaaaagactaaaaaaagtattactttagaatttagagggtatttttactttacttttactaaaaaaattaaataattctcaccataaaattaatgcaaacgcactatactcatgtccacgtagaattctattgattaaccatataaaaatctggtagatgaaaataaaatatgtatacattatatactttgcttaattataattttattttgagttaaaaaataatttaattttatctcaaattcattttctttaggaatgcttgacctctcttcctacgagccttctccatctccaatcacaatcttgtctctgttttttaggagagaaaagataaagttattccaaagataatcataagtcaatgactaattgactatggccacatcaccgttcaaaaaagaggaattttgctaagttgattttcaatataagatgtttgatgaattttttaagataaaaaataatttcttatttttttgtagttagagaaaatccaattaatgttgtagatttttaaaatttaaatctaagtattttatataaataatttattttacaaattcttaaaaataaaaaataatttaatatgctctaagtttctcttccatattcactcgggtagcgaaaatgctgcatgttttagccacttttttcatgtacgtgggggaataagactttttcttttttggtggaaaaagattaggctccgtaaaaagtgaaacagagcaacagccatctattaaagcacctccaagtccatccgaggtgctgatgtggttaaacttaaaaaggaagagaaaaataaaaaagtaacttgttcaaagaaataaaaacaaaaaaatcaacataacattgatttaaataatattaaatttcattttctaaataagatttcagatttaatataatgtttagtaacaaaaaaaaaaaaaagaagatacataaaataaatgaatagttatttttttatttctctaaaatcaaatacttttatttttatcgtatttctcacttattttatcaaatacttcacttatatatatttttttcttcttctattaagcacctcctaagaaatgattattggaacaggttcttgttaaatattcttaaagtagcatatgcttataagaatatcaatttttaaaagttttgtcggtgttatgtacgtatagctttatgaacaataaattatttttctacatttcataattattgttattttaccttttttattttaacattgttgatgcttaaacattttgaagtcttattaattattttttcatatctacttctatttaaaataactatatttattcttaaatttactaggaacattatacttgcagcctaaacatgaatatttaaaattgtattgcagaagagaagatagtggatatttaataactaaacgacaaattttaacatgaattaagagtaaaattcaattacattataatctagtagtgtgagtctatcaacccttagttagaaagatctagaaatatatgaaaagaaaaagaaacaagcaaaagggtagaaattatccctttctttataaattggagatgaataaaaaaaattcttccaagaccttacattgtcaagccttaaacaagcaaaagggtagaaaatatccctttctttataaattggagatgaataaaaaaattcttcttccaaaaccttacattgtcaagccttagccctttattcttgttcaggttttctacgtatgtccctctcagtttattataaaaaaaagtcatgggcttaaatacttgtttggtatttataatttagtttttttcatttttgtcttggtattttttttgttttaatccttttaaaatgtgtttattttattttttatttttaaaatgctttagattgtaatttgaacaataaaataaatgttttgaacaataaaaaaatattatttaaaactttttaagaaaaaaatattttataaggattaaatcatttttttacaagaacgaaaaagggaaaaattaaattataaaataagttgacatattttataatataaatgatatgttgagatgctaatgaataatttaaaataaattatccttcttcactttaagaaaagtgcattatcactataaacaaagttgcctagcatagcgcataaaggaaactcaaacttgatacttttatcattattattattggataaataattatttttgttttgtttttaaatacgtagatcctgataaaatttattcattaaatatgaaaatttaaatttaaatttttgaaagtggaaaaatatgataaatttatttattcgttaaattttgtttgttatcaataataaaagagtatatgtaatatatttaaggttgaatttgaagaataaaaatgattatttatttaaaatataatttaatatttttaatttttaatgattagaggtataatattataataaatatttaaaaaaataaaaaaataaatataaattaaaataatataataataaacataatattaattaataaatataatttatcaattgctcttaaaattttttaatgttataaatagtaaaagagaagagaaagcaaaatgacagtgacgctttaaaggaatacgtttcgtttttactttaaattctatgcataattatagtatacatctaattaattagaaattattgtttgaataacttgtaaaatatctttttagtgttttatagaacagtcagaaaggattggtcactagacaccaactttttggtagtgtttgaataatttttaaaatattttttttttataaaaataacaaacttatcatacttttttcatattttaattgacacgtacgtcctaataattgcttccttggccttctcatgactgttaaattatcaaattttaattaacacgtacgtcctaataatatttaacagaatttaacatttgttttaccttcctaagtaagaagcgagtaaatcatgatgggaatttgtggctgtttcaagatcactaggcaaagggtcttgaccatgagaatgtcctcccatgtgcacaatgtaggtctgaaaacacagaatccaaagcacgcaattggtacatcaacaaaatataaaattggaaattctcaaagttggaacttgaacagttacaaaactccataagattaatgagaaacagtaatcaggaaaaatgggtaacataaatttactttgttttttttcttttcttttattttgaggtatcacaagtccttagatacactggtgtattcatacaaacacacaataatttttctggtagaatacttatgatgtatttagataatggtctgccaagccacatcacgttggccttttacatgagatgctatttataatataacatgacttttaacttaaagacatgattcttcacttgagtaactcttcacctaagaacatgactcttcacatgagtaactttttcacccagggacatgactcttcacatatctaatttattattattaaagtttaatccaacaaaatccccccataaactttaaatatttcttccgtcttcatccccaacatcttacaattttccatctccgacttgattttagcttgccacatgaagtaactcctccaccttctttccttttacttgatctcggatgaatggaatctgacgtcgatatacttgctccttttgtgattgactgggttcttagctaactcgattgctaacttattatctacatggatctcggttggactatcttactttgatgggattaaacacacaatccccttctctgttgggagcaacacctcaaccaaccacaaacactggggagtcaccagactcaaccaagaatagctttacgtgggagaaaaccttcaaaaggaaaatccacgagacctagtccagaacaatccactattctcaataataatggttacaatcactctcaacggccttcaaccggagacactcaacctcaccaacaacaatggtggaaacgctctcaacaagggttgctctcaacctctcggagatgctctctcaacagcctaatgctggagacacaaacgagaatcctctcctcccttttttggaattttgaatcttctcttccacactaagaatattactttttagattgggcacgtaatagacatctcggatgcgcccaattcgtccatctttctgcaagaaacaaatcgtacctcggcctttgacatcaacctttgaagcatttccaaacgaaacatgtctggcttctatttgtctcagattactgaacaaatgtttatgctcacacatatgattacttgcactagtgtctagataccattctatctcggatccctggttgacttcacttctagtcatcatcagaattcctccatctcttacttctccttttgtaacaaggtttgaagtttcattacttctttcatctcggcaatccttcgcaaaatgtccgacttgaccacagttataacatctgtccgagtttcaatctctcgactaatgtccatactttccgcatttaaaacattctacattcgattgatttgaatgtcggcctcttccactacctcggcctcgccaattctgccgacttgattcaacctactccttattccttccttcttgacctcggcctctaccccctcggtcatgtccacgacctctatctcgaaaattgtgagaatagagcgctttctcgtctttgattgaagcttttgtctggagtgcttgctccaatgactcttttttcctctttttctttctttgttcatgtgcctccaaggaaccagcaagttcgtcaaaggtgagcgttgctaggtcatttgactcctcaatcgcacatacaacattcttgaagccgtcagtgagagatctcagaattttctccaccactttggcatcggacaacacctctccatttctgtttagttgatttaccacggtctggacccgggtgatgaaaccggataccccttctccttccttcattttcattccgttgtagacatttgcaagaatgtcccacgcctcctttgaagttgttgcaccagcgatcttctcaaacccggaatcatcaacagtccggaataacatgtacaacgcccctttgtctttcaaccttgtctccttcaatgtcttgttctgcgctgccgtatatcctgctgtggatgttggttcctcaaaaccaccatggacaacctcccaactatcatgggctcctaaaagagctttcatctggatactctagttttcgtaattagcctttgtaaggtaaggtaatggtagactactacttgacccactctccattttctcacgctctgataccaatttgtggtatcccaggtcctcacacactggtgcacttacacaaatacacaaaaatttctctgatagaatacttttgatgtatttagataatggtctgtcaagccacaccacgttggccttttatataatatgctatttataatacgacgtgactcttcacttaggaacatgactcttcacatgagtaacttttttacctaaagacataactcttcacatatctaatttattattattaaagtttaatccaacacgtttttcatcctacttctattctatggttttttttccccttatctttctccctttatttttcattataacatttattacatccttatttgttattttttattattattcttttctcttcaccgtacaccaaaacaagaaagcaatgattcaacatttatcataacagagtaagaattgtgcccgagggagataatgcattttgcatttatatgggcaacaattaaagtggctgagttatgcataataagagctcaatatgaaatggattgttttcagctttgtcaggcgtggaagaagcatatttctttttgtttttcttttttcttaatattaggtataagaagaagcctatttcatagtctggtagaggatgtgagaagaattagttctaatgcttcaaggcaagaattgctatttacaaaacagaaaaggcaagctgtccgttgtttagctttatttatttgatggatgttggattcaagaggaggtcccatttcagttggaccaattcatgagcaatgatgtctcttctctatttcatcaataatatttgagcatcttgaatttgaaaaaaattctgctttcaccgttttctggaagcacgattttaatgtaaagaatgattgatgtaccaaatgtgtgttacatactgagaaataatttattatgttgaaaaataattaattatttctaagttcctataagaaaaataataataataataataataataattaagatttacttaaattacttttaagattctatgaggaaaaataaaatcaattatattgaaaatataatttgaatttgaattattgtttctcttagatagaaatatgttgttaaaataatttagataagaagaagtttgaattattgtttcttaatattgtacttaatttgttaacattatttgtataaatatacttatttaagatgtgaaatatgagtgaatgaataagtgaataagtaaatgaagaaatagatgaataaatgaataagaaattatttttacaaattcaattaatttatatcctgtgacaagctctccgatatacataaacttcaactttaagcccaatttcatgtgtgatccgtgttaaatctgactagattctctccatgaatcaaccaaaagaaaaaaactcagctccataaaaagtataaatctatgtttaaagtttcttcaaacatcaagatcatcccaattacattattggggtccccaagttagacttgactttctttgtgagtttatgttgctcttctttctaagtcttggacatcttctgtttcctggcacatttttcttacgttgaaaaacacaaataagtaagtgcaatcatactacttctcaactaaaaatgtcaaaacatgaatcacatgaaagtgtagacaattgggttattttcttacaaaaatttattaagttaattaatgcattaaaacatctaaaatataattggaataattggtttctagagttatgctcttaaacccatgcatgcctagtacaattgttacaacaataatcatataactatgcggtattacatgatttcttacaaagcagaaagacaaaaatgcttacaatgcaaaataaatccaagttcaattattttagagttattcaattgtaataacaggaaatggacccattaaaggtgatattggcatcacaattcacaaacacctgacatacatgtttcacagtaggacgagattgtggactttcactcaagcaagcaaatattacttttgcaactactatcaaccacgaagctattggcttcattggaagcggaagttttgggtccaacacactcttcaataacaaattagatgctgatggcgttgttgacaatgaaaacaatgaagagatgagatcaccaggatgctttcccacgattattttcaaagaaaggactccaaaactaaaggcatcacatttctcattcacttccatagtataagcaagctctacattaaattaaaatatgaaaataaaattgctcgtatagaagtagaaacaagagtgtgtaagattaataaatgccctcaaaaagagttaccggctattagactatggcaccttttccagagtcggaaaagggtaggtcattacagttttgatgaaacctatgtatgtttactgtggcaatactaataactaaaaatagctttccaaattccaattgtactcattcactgacctttattattgcttgtaaataacttcattatagtctataacacgtactgctgtcttatactcatcctttttctttaatcttaagcatacatacaaaaagaagtgttggaaaatttgaggatcaagccaaaaccaatgtaaatttctttcattatatataaaaagaaacattattccagcaaacgcaacttaattttgatctgtttgacatctcaactgctggataatttatcataagagtcattgcaaagttcactaaactcaaaaaaaaatcttggatatctcggcatcttcttggtcaatacttgatgaatgatgacaattcctcactaatataaaagaaatgaaatgagtgataaattagtgataaattggccaatgtaaacctgaggaattgtttcggtttagttggtagctgggatacaaatgaaatgagtgataaattaggaatataaaagaaaataataaaaaatgaaactgaagtaaaacatgactattcttataatcttgatgtttaaattgttgttaagagaggtgttaatgtttgaataaaaatcaagctttgcgatatcaaattatttaaatatatttaattatttccctaatatatatatatatatatattaatgttaagtatcaatgttatattttatctactctttagttttaatagtagttttatgtagttttaagtatgtagcctagcttttagcactctatatatataaacagtgtgaaaactataatcatgtgatttgacgttcataatgatgttgttaatgggccaagtagggaagtggtcgttgttccacatttatatgcttgttttacgatattcttctctaatttaggttggtatggacaaatcaaattaacatatgttaaaacatatattgaagtaatgcatttgatgtatcttattttaatttcagatttttgaaggatttatttataaaaaaaacataaagtcaatcactaaaatcccaaataagtaagtgcaatcatgctatttgtaatctaacatcgtcatttgtcatcgcgtcatgagaataagatggggtttctgaggtgacccttcattctctcttttctcttcatttctcttctctttctatgttcttctccccccattcttcattttcgttttttttttttgtttttgatttcttttggtttgtataatttctccttctttccattgtttctacatggccattgatctgttgtaaccagtggcggaaccagaaatttttttgagggggggcgaacataaaaaaaaattatatcataaataaaagtactttgaagacaatacaaatctaatatacaaaaaaatgcaaaacgcaaaccacagacagacaaattgcaaacatgatggattgatgaacaagctgacaaagtctagtgagtcttaataaaataattcataatttaaaatcaaaatccaagtaacaatatggagataagagataaagaagatacaatcagttttagcttaaaaaacttaattggataaaaaattacaacatccaaattggataatcaatccaatggacaacttcactatgataataaataagtacctttaaaattctgatggagagttaagaatcagacttgtcaaacgcttctatatgatctcataacaattctctcaatgatgcaaacataaactctctaaagctctaatattatttggaatggaatgcatacaattaatataaaaatatgtttctatttatactaatttaagcatacgattttaaacaatttttgaatgcaatcctaaaaatattttatcatattatacaatgcaatcttaaatatattttatattatgcaatacaatcttaaaaatattatatcctatttttgaatataatattaaaaaatattctatactatatttgaatgcaatcttaaaaaatattttatcttattatgcaatgtaatcttaaagatttatattatattatgtaatgcaatctcaaaaatattttatcctattttttaatgtaatattaaaaaatattatatcctattatattatacaatataacttttttattattaaattattttttaatttttaatatatatatatatatataattttatattagtaaaattttagggggggcgggtgccctccctagccccccctgtttccgcccctggttgtaaccttattacttcttttatcttcttccatagattttttttttccgtccaccatcgtgccaccaccgtcgcgaatcaccaccacgccaacaccgtaccactgcaccgccaccacatttcggcctcaccatggtggccaccgcaccattggcccctatggtggtgacctgaaaaggtcacaaagcctccaaccttattttcgcgcagctactctgcccatcaccaaaacacgggttgggctgggtagccctgacctgatcctaaaaaaagcttttactatttgcaccctagcttctcttaaatacacccctgaaaccaaataaataatgctttctgcacatccagattttcataagcacacccaaacatataatgctgtttgcacctttcttttcataatcgcacacccaggcccattctagaaaacatttattattgtttgcacctctttttttataattacacatcccttattgttgggcctgatccactttaaatacaacatgaaatgctatttacacctatctttctcataattgcacaccccttttaggttgggcttggcccacttgaaaacataacgtgtaatgctattcacaccttccatattcataaatgcatcactaatctgttgggtccgacccattttgtaatttaacaatttcttcttattgcactccctgtcttattgtacgctcccctaattactaagtgtactccttacttctattatatccacttctatttccattttaatttatctgataacgtaatgttatgtcaattattcattttttttatatagtacgcgcttatgtttcgtgcactccatgctgggtctctgactcgcttggtagtgtttcaataacacgtggatagatttgtgaatatcatgctggatctccgacttgcttgatttcatagagtttaccgcaaattcaaaatattttctaaaaatagataaaaaaaatactcaaataaatgatcactcaattctcctttttctcaaaaattacattttacttgagatcgcttcaaggtccaatgccttaagcgattctcttagctccctttcaaaattcaacgtcgcttcagggttcaatgccttaagcgattctttccgctttttccttaaaattcaatgtcatttcaaggttcaacgccttaacaatttttttttcatgcaattgaaacaaatctttttggaaaaaataaaatcaattcaatcaagttgttttttaaaaaaaaaagaactacgtaagtttgatttcttcattgtacttggggatacgtacaaacccctcgtcgacctaaaagataatatatatatatatatatatatatatataatcttctcttttctaaaaaataaaaatttgattttcttttctaaataaacaaaaataaaacaagcatagtcatgatcttaagaaaaaacaaataattaaaaagtcactttatgtttaacacactcgattaaagactgttgtattcgtgatggacgcgtggggtgttaacaccatccctgtgcataaatgactcccgaatctttttttctctaaaatcgtagactataccttatcttttagtttttccgacgttttccttaaataaacgttggtgacgactctcctctaattttctttttttttttgggaatctttctaatcttcttttttcatagccttccctgtcgtggctgaataggttgcgacaaggaaaaaatgcagtgacctgctcattggtgcctacaaaggaggttaaattgcatgaatcagtattcagaattttagcagttccaaagtcagagatgcgagctttgtattccaagtctataagaacattcctgcttgatatgccacgatgaagtataggaggagagcaactatgttgcatatgctatagagcactttacacacctttaactacattcaccctgctattccagtcaaacattattgcttttgcatcatcctttagtactttatccaagcttcccccttcaagtaactcagagactagaaacgagaatcgtggatctgaacaaaacccttttaaattcacaatgttatgatgtttgatttgtgttaaggcttgaactttgcttgtaaaacattttaaattgagcatttccctatccactgcagcatgaaattttttcacaggaacgacatggccagatgataaactagccttgtaaacagctccagaatctcctcctccgatgagataaatatcatcaaactcctttgtggattcaatgatattttgagacactgttttttcatcataacccaatatggaaaaataatcttgagtttgttcttttatagcctgtttttctgattttcttgctccctggtgatgaataagacataatgaacctccaaccacgaccacaactagaaataaagcacccgaggtcaagtaaatcgccaacatgatgacatttttccttttactgtcattgttgtgactcaactgttggcaaggtgtcaagcccgagatattacttcacaagtctttattgttttccaatgcttcagatggagctttaagaaaggctggaatatcaggaattggaccctctaattagttgttagatatgtcaacatttgtcaaactcaacaaattcttaaaattggatggaatggtgccagagattattgtgtgagagattcaaattttccaatctgtgcaactttccaagtgatatggtattttgccatttaacttgagcagtcgtccaagttgatttggaattggaccagttagactatttgctgcaagcttcaaacgttgaaggtttagcaaagatcccatttctgtgggatgtagtcagaaaattcattgtgactcagagagttcaaacaacagggtcaatttaccaaaattctttggactttttccacttatattagttgaagaaagttgaagttgttgtaatttgggtgcctggccgagctctggcggtttaccaccggataagttgttgctacatattttaaggcttgttagactatggcaattggcccaaattggtgaaatgtgaccataaaaattattccttgtcagatcattgttgttcaaatgtggatatacaccaaactcgtcggatatatttcctgtcaagtggttgtctccaagtatgaatctgacaagggtggaacaattcttcaagcttgttggaactggacctgtgaaaagattagtggtagcaggaaaaaatttcagcaccttccgaggcaaatatattgtggaaaagagccagagaaatcatttaaactcagttgtaagcttaaaaaattggtaaagttgttcattgctggtggtaaccattaaggttgttgggaatgaatagttccagaaagttggttttctgagaggcgaagcctctgtaaattgaccaagtttcctatggaaacaggaattgtcccagaaagatggttttgctttagggccaattcagtgagtttgtcaaatttccaaagagtggaagcaattgatcaaacaagtttattaccactgagcataagtgtgtgctcaaagtggccaagtctcctatggaagatgggattgggcaagacaaattattgttcaacaatttgattgctttgggagaataatgttttccaaactcctcaggaatggggccagagagatggttgttaaacaggacaagatgtattaagtttctcaagttcctaagtgaagggatggcaccgagagattattagttgacaaatcaagtgtttgttgccagctaaatctagctatgataagttggcttgctttgctatggaaactggaattgacccatttagcttacatttggagatgtcaaggtgactctgacctctcagtgccccctatttcttgagggatggaaccactaaaattacttttatccattttcaattgagaaactctggacaactgaccattatcgtggggaatatgcccatgtaaggacttgaaacttacatccagattgaacaagttaagaaaggatgacaagttgagattgagaagagttccttgtaacccaattttttttgaacatttattgtcgtccaacacatccttcaataacaaaatagatgctgatggtgttgttgacaatgaaaacaacgaagaaatgagatcagcaagatgctttcccaggattatttccaaagaaaggacaccaaaacaaaagagcaacacatcaagtttctcattcgcttccatagtataaacaagctccacaataaattaaaatatgaaaataaaatttactcatatagtaactgaaacaagagtatatggtatataagattgatgtcttaagagcaacaatgaagtgcctaacctggtgcagcatacctataggtgcctacaactacaaaggaggttaaattgcgtgagtcagtattcagaattttagcatttccaaagtcagagaagcgagcttcatattccaagactataagaacattcttgcttgaaatgtcacgatgaagtataggcggagagaaaccgtgatgcatatggtatagagcactttccacaccttaaactacattcagcctcctattccaatcaaacattattgctttatcatcctctaaggctttgtttgggagttaggaggggaaggaaaggaaagagattcaagaggaatggaggagaaggaaagggaggaaaatgagggaagttccttcctccttgtttgagagttaaaaatatattaagagaggaaaattgagagttaataagatattaaatatgaaaattatataatttaaatataaaaatatattaaaaatatattttaatatattttggaatttatagttggggtagaatagtaattttaattacttttccttctaaaaaccccccaaggggaacaacaatttttaagctttggaggattttggaggagttttaaaaatcctcaaatcctttccctcaaaaattaaaactcccaaacaaggagatgacaccatctaaacctttcatttcccttccttccccttcaaaatccctctcccaaacaaagcattagtaatttgtccaaactctcccattcaaggaactcagaccagaaacgaaaagcatgtatgtgaacataacccttttaacttcacaatgtgaacaaaaataacttttaccggtaattgttataccatttaccggcaatataaatgccctcaaaaagagttaccggctattagactatgttaccttttccagagtcggaaaagggtttaccgccattataatgaatgctggtaaaggccattaccgttttggtgaaacctatgtatgtttactggcaatactaacaagtaataactaaaaatagctttccaaattccaattgtactcattcattgtcctttattattgcttgtaaataactttattatagtccataaaaagtactgctgtcttatactcattttttttctttattcttaagcatacatatataaagaagtgttggaaaatttgaggatcaagcgaaaaccaatgtaaatttctttcattttatataaaaaagacattatttcagcaaacaccacttaattttgatctgtttgacatctcaactgcaggataatttatcataagagtcattgcaaagttcactaaactcaaaaaaatcttggatatctcggcatcttcttggtcaatacttgatgaatgatgacaattcctcactaaagaactcttgcaatccattaatcaaatttagattgaaggatttccctgttatgcgacaaaagttataactttagggaatcatatcaatagagtatactgtgatgcatgtcatcttgaccaacctgtttaaatacaacaaaactatctatataaatggaaaggtgaaagaatagtagttcatggagtttaaacacattattctccaaaattatttgtttcaacaatattaacatgtaaataaataagaacttaaaagttatgattgactttaagccataattaggaaaacgagtaaacaaaacaactggtaggcaaaatatgaggaatttcaaaattgatagggaaaaaaacagcttacgtctggtgccccaaacatcaaattaggaggaatttacacctcagtaaattcttgattaataataccacgattcttgcctcaaaattgcacacgaaacacctgaaaattagtccctcctcattcgtaaaaagggaagagatgcaaaagaacaaccaaacagtaaaacatttgttcaaagcctataaattttcagaacgttccaaaacacatgaataataataataataaatgcacattcaccacagaaaaagtatagtagttgaagtgtgaaatgtcactaaattgattctctttcaccagaaccacatatggattaatatcatttagtactatctaaatgtattttcctttacctatcatcatgaatgaaaaatatcaatgttatcttttatcttctcttccgttttaatagtagttttatgtagttttagagtagcctagcttttagcactctataacatggagtgtggactgcaatatacatggtgcgccagcttcttcaatctttcgcactcagcaaattgctaacttgtccagactttctcaattgataacgaatactaataattttagtggctcaatccccacttccatgatgaagttggctagcttgtcaattctaaacttggaaaacaataacctttcgggctctattcctgaggagattggagaattgcagaacttgaagcgtctaatacttcaagggaatcgactttctggtaccattcctccaacaattggaaggttgtccaaccttgttagacttgaattgtccaaaaactctgtctcgggtacaatccccacttcaattacaaacttgacaaatttagaactccttcagctctcaaacaatagtctttctggctccattccatcctccataggagacttggtcaatttgattgtttttgaaatcgatcaaaataaaatttcaggattaattccttccagtattggaaacttgacaaagctggtcaatatgtccattggcgataacatgatttctggatcaattcccagctccatcggaaacttggtcaatctaatgctcttagacctttctgtaaacaatatttccggagttattccttccacctttggaaatttgacaaagctcacctatttagtagtgttaaataacacatttcatggtagattaccacccgcaatgaataacctcaccaatttcataagtttacaactatctagaaacagtttcactggccctttgccgcaacaaatttgccttggtggttctcttagcagatttgccgctaactataattatttcacgggtccagttccaaaaagcctgaaaaactgctccagtctttacagactcagactagatggaaaccagttgaccggaaatatatcagatgcttttggtgtatatccagagttgaactacgttgatctgagtagcaatcacttttatggccacatttcaccaaactgggcaaagtgtcctgttctcacaagccttatgatgtccaacaacaatttatctggtggtatacccccagaactcggccaggcacccagcttacaagtactagtcttgtcttcaaatcatctaacaggaaaaattccagaagaacttatgaacttaaccactttgtttaagttatcaataggcgacaatgaactttctggcaacattcctgcagaagtaggagccttgtccggccttacaagtctcgagcttgcagcaaataatttgggtggcccggttccaaaacaggtgggagagttgcgtaagttactttacttgaacttgagcaagaatgaattcacagaaagcattccttcagagtttaaccaactgcaatctcttcaagatcttgaccttagtaggaatttgttaaacggaaaaataccagcagaacttgcaactttgcaaagattggaaacactaaacctctcacacaacaatctctcaggagccattcctgattttaagaatagcttggcaaatgttgacatatctaacaaccaattggagggttcaattcctaacattccagcctttcttaatgcttcatttgatgcattgaaaaataataaaggcttgtgtggaaatgcctccagtttggtgccttgccacaccccacctcatggtaaaatgaaaagaaatgtggccaatttggcattattccttactttgggttctctaattctagtatcattcgtggttggagtttcgttatgcatttgctatcgaagagcaagaaagggcaaatcggaggaggctaaagaagaaagaagtcaggatcattactccatatggagttatgatggaaaattagtgtatgaagatatcatggaagccacagaggggtttgatgacaaatatctcattggagaaggagggtctgcatctgtttataaggcaatattacccacagaacatattgttgctgtgaaaaaagttcatgcttcgaccaacgaggaaacacccaatttaagagcttttataaatgaggttaaagccttggcagaaatcaagcatcgtaacattgtgaagtcacttggatattgtttacatccacgcttctcctttttggtttacgagttcctagaggggggtagcttggataaagtactaaacaatgatacacatgcaacaatatttgattggaacagaagggtgaaggttattaaaggtgtggcaaatgctttgtaccatatgcatcatggatgctttcctcctattgttcatcgtgacatatcaagcaagaatgttcttatagacttggattatgaagcccacatttgtgactttggaacagctaaaattctgaatcctgattcacaaaatttaaccgcatttgcaggcacctatggatatgctgcaccaggttaggaccttttttttttttttttaagaagttaatcctatacatacttgtttcaataataagtcatgctacttcttgtgtaaatcattttcatattttgatattttacagagctttcttatactatggaagtgaatgagaaatgtgatgtttttagttttggagtgctttgtttggaaataatgatgggaaaacatccaggagatctgatttcttcattattatcaccctctgcgatgtcatcagtgtccaatttgctgttaaaggatgtgttggaccaacgactacctgatccagtgaagccagttgttaaggaggtgatcttgattgcaaatataacattagcttgcttacgtgaaagtccacattttcgccctagcatggaacaagtgtataacgagtttgtgatgccaacatcatcttcagtgaatttattctccatgatcacacttggtcaactcagagataattgaaccttgttttatggtgtattgtaagctttttgttatattaatgtttgttgtgtgtgttttacatgtttcttctattttgtcagaactggaaaatattgcaaaactgtcttatgtctttaagtaagaccctgagtctttattttgtaggttgaataaatacggtctagttttaaagggagacagcagtgatgtctttaagtaattaaggatattttgactatatatttcaacattaacgtgccacttgaactctgttccaattcatgatacatagtctaaataccatttaggacgatggccaatttgcaatagtgatttttattaaaatctattgttcaaaatatccttatgcgaattttcttgcagattaaccatagatctaagtgatattcaaaatacagttgctacaaaggaagcagtttgggattttagcgcagctagtcatcactcatcagtacggcgtctaatttcattttttttattttctaatcaaatctaactagcatgggattttagcgattgactttattttatttatgtttaaataaatccttcaaaaatctgaaattaaaatcagctaaatcaaatgcattacttcaatatatgcttccttgattccgatcaggtagagcactcttgcacgcggcccaatttgaacgtaattaattatagtgccagctgttagattaattgaaaatatatactatgattattatctcaaactcactcaaaaaattgaaccaagttgccaacagtggtccagaagcgaggaggaaaaacaaaaaaaatctggacctctcgactttgaaaattcaagaaaaccttatctacccttatcctaaacaagatcgcatgttggtatcttgattggaaaaacttgtattgaatggcaaagtatatgataatttcgtttctattatatattatgtatcatgtttgatttgtggaccttacaaatacacaagtcttttcacaccacgtggtgggaatgttaatttgatttgtatatataccaacctaaattagacaagacacaagagtatcataaaacaagcatataaatgtggaacaactaccacttccctacttggcccattaacaatatcattatgaacctcaaatcacatgattatagtttgagtaaattatattcacatgtcattgtgtttttttattaaattgtattcgatattctttttttattatatattacttttatcccattttgttaacatcgttaaaaagtcaattgacataattgaatagacaaaattgctcattagagtaaattacacttgcacccttgtatttttttttttcaaattgtaggtactcctccttttttatacattattgatatcgatggacgcgttaagactgttgatgtcattggccctgacgatgtcgatgttcagggaaccagacaaagcggtgatggtggtcgaaactacgacaggggacgaagaggtgatggaggtggatatggcggtgattacggtggaggtggtggctacggtggtggtcgttgctcatacgggagtggatggggacgacaataaggaggaagagatgatgttgtcgtgggagagagaggaggaggagaagaaggtggtggtggtaagtaaagaaggattgtggaagaaaaagagggtttataaaacccaatatttgattttaggaaagaagataaagttatattaattgtgtttaagaaggagaaagtttgggtgtaatataaactaaacaattaaaagaattttttgtaggatgcaaaaaaggaaaaatatactaagtataatttactcttataattttcacactatttaaattgatggaccgggttaaagtcttgggcaatttcaatgtaaataactgatttgtgctttcctagtgatgccgcctgcagctaaggttttaacttgtggtcatgattagcgttgcgttttcattataatctttgtaatgtgcaaaattgcagataatacacaattaatgcagcctgagttaatgtaatggtagagatctcaatttttttgacgttgcatataaataatttttttttttaaaaccttggatgcagcaagaagtacatatatgccatacatgtagttaatacttaatactttgtttcttgaagcattcttgagggaggaagaaactagccaagttctaaaatgagaaattaagctggagtaacaaacaaacaaaaaagatataatgttgtgataccctggcgacaaattattagcacagtgccaaagattgaagaagctggcgcaccatgtatattgcagtccacactccatgttatagagtgctaaaagctaggctactctaaaactacataaaactactattaaaacggaagagaagataaaagataacattgatattattaaaaaatattaataataatttttatacttaatcaaatagaaatgaaaataatcatagaactaatagaaatcattaaaattagaaaaatattaatatgagttttttttaatcaaaaaatattatttttggcaaaaaaaactgtttttgacaaaaaaaagaaagtaaaaactcactttgtggcggttttcaaaccgccacaaatagaaaagtgaaaaaataaaaaagtaacatttgtggcggcttttagccgccacaatgtttttgacgactttaccagcgttcaactaaaaatcgccacaaaattttctgacatggttacttctgacagtcaatcctgatcgtcagaaattaattttgtggcggtttttagccgtcagaaaacgcttttttagccgccacaaaaatatcatttttttgtagtgagctttaaagtaacttaaaaactagtaaaaaattataattttttcaagaatcttaccaaacataagatctcgtgaaaaaaatatcataaaaaagttaaaagaattaaaattttgatacaaaaccaaaagactaaaaaaagtattactttggaatttagagggtatttttactttacttttactaaaacaaattaaataattctcaccataaaattaattcaaatacacgatactcatgtccacgtagaattctattgattaaccatatacatatctggtagatcaaaaataaaatatgtatacatcatatactttgcttaattataattttattttgagttaaaaaaaataaattttatctcaaattcattttcttttgctaaacactctagatttttttctttttagtgaccaccaccactgctacctaccataacaacagagaatatatgaatgcttgacctctcttcctacgacccttctccatctccaatcacaatcacatccaatttatgtatcgtctctgttttttaggagagaaaagataaagttattccaaagataatcataagtcaatgactaattgactatggccacatcaccgttcaaaaaagaggaaatttgctaagttgattttcaatataagatgtttgatgaattttttaagataaaaaataatttcttattttttgtagttagagaaaatccaattaatattgtagattttttaaatttaaatctaagtattttatataaataatttatttaacaaattcttaaaaataaaaaataattgaatatgctctaagtttctcttccatattcactcgggtaacgaaaatgctgcatgttttagccactttgttcatgtacgtgggggaataacactttttttttttggtggaaaaagattaggctccgtaaaaagcgaaacagggcaacagccatctattaaagcacctccaagtccatccgaggtgctgatgtggtgaaacttaaaaaggaagagaaataaatagttagaaaaaaaaaaagtaacttgttcaaagaaataaaaagaaaaaattcaacataacattgatttaaataatattatatttgattttctaaataagatttcagatttaatataatgattagtaacctaaaaaagaagataaataaaataaatgaatagttatttttttatttctctgaaatcaaatacttttatttttatcgtatttctcacttattttatcaaacacctcacttacatatatttttcttcttctattaagcacatcctaagaaatgcttattggaacaggttcttggtaaatattcttaaagtagcatatgcttataagaacatcaatttttaaaagttttgtgggtgttatgttcatatagctttatgaacaataaattatttttctccatttcataactattgttattttagctttttttattttaacattgttgatgctttaaaatttttaagtcttgttaattattttttcatatatacttctatttaaaataactatatttattcttaaatttactatatatacttgcagtgaatatttaaaattgtattgctgaagagaagatagtggatatttaataactaaatgacaaatttgaacatgaattaagagtaaaattcaattacattaccatctagttgtgcgagtctatcaacccttagtttagaaagatctagaattatattaaaagaaaaagaaacaagcaaaagggtagaaattatccctttctttataaattggagatgaataaaagaattcttccaagaccttacattgtcaagccttatccctttattcttgttcagggttttctacgtatgtccctctcagtttattatgaaaaaaaatcataggcttaaatacttgtttggtatttataatttagttatttttttcatttttatattggtattttttttttgttttagtccttttaaagtatgtttattttatttttcatctttaaaatgctttagattgtaatttgaacaataaaataaatattttgagcaataaaaaatattacttaaaatgttttaagaaaaaaatattttataaaaaaatcatttttttacaagaacgaaaaagaaaaaaataaattataaaaacagttgacatattttataatataaatgatatgttgagatgctaatgattgatttaaaataaattatctttcttcactttaagaaaagtgcattatcactatgaaaaaagttgccagcaataaaggaaactcagaataaagtaaggaaaagtgtgtttggaaacgagacaaaggcattataggtgcttttcttccctttgtctcaaacttgatacttttatcattattatttttaatgtgtagagtgccgataaatttgtttataaaaaataaaaattttaattttaatttatgaaagtgaaaaaaatatgataaatttatcaatatattaattttcatctgttatcgttaatgaatgagattatgtgttacatttaggaaataatttgtcaatattttacacattcatggatgaaagtgactatttattcaaaatataatttaatatccatctttctccattttttaatcattgtaaacataatattataataaatacttacaaaaatacaaaaacaaacgtaaattaaaacaaatataataataaatataatattaattaataaatataatctattcattaatatgagaattctaatgagaatcaaacaaaaatattaagttaatccttatatataccatccccttgaccccatatatattccatttctaactcaggcaacaacgtatataatttcatgttacaatgtatgattatatatatatgttacctgaatccagaaacaaccagcgtcgaaggggccaaagtttcacgtgaaatttaaatgtacaaattcgtcaaattgtatagtgcggaccgcaatatatatgcatgatgtatttttggacacactgtcacaaaatttgtcgacagggtatctaacattttagaattttgctagttcattcccctctcactcaatgttggataatgttccgtttaatgcttggcctaaatccctaggtgttgacaaaggaaatattgacttgggcccaattcccgatggttgacctcggtccatttttcccatttagggtgctgaaatccctaaacctaattctctctatggaggcaagaggaccagcactaacgacagagagccagtgacgtgagagtacagaacacaacagtggtgaggaagagtgtctccgagaggttgagagtaactcttgttgagggtgtgtgttcaccattgttgagtgactccggcgtgaagctgttgagtatttgtaaccattattattgagaatagtggattgttctggactagatcccgtgggtttttcctcttggaggttttctcccacgtaaagctatcttgtgttgttgttctctccctttatctctcgcgcatccttcgtttgatcgtttcatgtttccgcgcttttgttttactgtttgattggttgagagttgagtccagtgactcctcagtgttcgtggttggttgtggttggttgagacaattcctagccgagaaggaggttgtggtgatcggggtgaccgagaaaaaaccacaacactcaagaaacaaagtactaactacatggcatatcagtcccaatttctacatggtatctgctagcattaaataagttttttcaatgcatgaatcattaaatcaaagaatcttgttaatttgatggttgaaactattaatattttatgcagtaattaatgtattttcagactaaagtacaaccacctataccttttggagtgtcttaagctttgtatttatgttggacaggtggctcattaacctgttaggtagtagaaatctgctgtgctattttgtcagtcagtatatggatcagaaacataacatattgctgctgtatgaatgaaatacctctcacggttcttatttcatagaaacttcttgtaccagcaaaactattatgttacatacctctgtaactagtttttgtgaaaagcagtagattcggcaataatcaattaccatttaacataattggttgctttgcttggatactagtttctaaatactcgttcagtaataattgattacttgtcatattaattgattacattgatctgaatgtgaaccaagatgttttgttggatagtttaattgatttaattgaagcaataatcgattacattagttacagaactaatggaataacaaggttgaactcttttacaaacggaaaactcttcaagaaaatattttttaggactatatatggctaaatatatctgcaagaaagctcgtatatggatattttgaagaatatatgtattagacaaatggtaatgaatccaaagaaagggagaactgaatttctaaaaatcagtcccaaaactattttcttgaaaacttatagacacaatttgataatgtaattgtgtaattgagatgtagagagtatagccaatgtaaatctaatgcaatctatatgattctaacacgattacagcatatagaaatcaagaaacattatttataacaacaacacagtgagttgaggaataaagagaatgtgagacacagtcacacagatgttattctgttttgatcattactgatctacattcagtctccggtaaaccttgctgagattattcactagttaaagcaataaaaaagcttacaacaggcaggaaacaagaaggttcaattatctacgagttgaccaagtgtgaccatggagaataaattcactgaagatgatgttggcatcacaaactcgttatacacttgttccatgcttgggcgaaaacgtggactttcacttaagcaagcaaatgttatttttgctatcaagatcacctccttgtcaactggcttcactggttgaggtattcgttggtccaacacatcctttaacagcaaattagaagctgatgacgttccagtggatgtaaaaaatgaagaaatgagatctcctggatgcttccccatcattatttccaaacaaagaactccgaaactgaagacatcacatttctcgttcacttccatagtataagcaagctctgtaatatatcaaattaaatatgaaaatagtatcatacaacaagtggcagcacttattattgaaacaagtatagttttgatttcttaataacaaaaaggacctaacctggtgcagcatacccataggtgcctgcaaacgaggttaaattttgtgaatcgggcttcagaattttagctgttccaaagtcagagactcgggcttcataatccaaatctataagaatattcttgcttgatatgtcacgatgaacaatagaaggaaagcaaccatgatgcatatggtacaaagcacttgccacacctttaacaaccttcaccctcctttcccaatcaaagagtgttgcatgcgtatcattgtttagtactttatccaagctacctccctctaggaactcataaaccaaaaaggagaagtgaggatgtaaacaatatccaattaacttcacaatgttacgatgcttgatttctgccgaggcttgaacctcacttgtaaaagctcttaggttgagtgtttcctcgttgggtacagcatgtagttttttcacagcaacaatttgtcctgtggataaatttgccttataaacagatgcagacccaccttctccaatgagatatttgtcatcaaacccctctgtggcttcaatgatactttcatacactaattttccatcataactccaaatggaaaaaaaatccttggtttgttcttctttagcctcctcctttttggcctttgttgctctttgataataaatgcataatgaaattccaaccaccaataataatagaaatagagcgccgaaagaaaggagtaatgccagcatgatgacatttcttttcattttatcatgaggtagggggtggcaaggcaccaaaccggaggcatttccacacaagcctttattatttttcaatgcatcaaatgaagcattaagaaatgcgggaatgttaggaattgaaccctccaattggttgttagatatgtcaacatttgccaagctattcttaaaatcaggaatggctccagagagattgttgtgtgagaggtttagggtttccaatctttgcaaagttgcaagttctgctggtacttttccattgaacaaattcctactaaggtcaagatcttgaagagattgcaattggttaaacgaaggaatgctttctgtgaatttgttgttgctcaagttcaagtgaactaatttgagtaaagatcccacctgttttggaattgggccacctaaattatttgctgcaagctccaaattttcgaggcgggacaaagaacctatttcggtaggaatgttcccaaaaagttcattgtcgcctattgatagatcaaacaaagaggtcaagttcccaagttcttttggaatttttcctgttagatgatttgaagacaagacaagttcctctaacatgggtgcccagcctagttctggtggtataccaccagataaattgttgttggatatcctaaggcttgtgagactaggacaccttgcccagtctggtgaaatgtggccataaaaattattgctactcagctcaacgaagtataactctggatacacaccaaaagcatctgagatatttccgctcaagcgatttcctgataggtttactctggtaagactggagcaatttttcaggctttttggaactggaccggtgaaagaattaccattagcagcaaattttctcagtgacccatctatgcaaatttgttgtggcaaaggaccggtgaaacgatttgtagatagttgtaagctttggagtttggtaaagttattcagtgctggtggtaatgtaccatgaagtttgttattaaacactagcaaaaaattgagctttgtcaaatttccaagggaagaaggaataactccggaaacagtattcctagacaggtccagcgactctagattgatcaagtttccaatggaggtgggaacggatccagagatcatgttatcggctaagtatacaatgccgagctttgtcaagtttccaatatttgaaggaattgatcctgaaattctattactttcaaaatcaagaaatttcaaattcaccaactctcctatgtagggtgggatgggaccagagagactattgtttgcgagcctaaggtgttctaaatttgtcaagtttctaattgatggaatggtaccagaaagtttattgcctgttaagtctagcaaagacaagctggccaacttcatcatggaaatggggatcgaaccatgaaaaagattagcatccattttcaactgagaaactctagacaagttagaaatttgctgaggaatgattccattaaaactgttgttactaatatccagagttagcagcttgagaaaagatgaaaatttgagactgtgaagagtaccttttagccccagatttgccacatttatagcggtcacatagttggattcgtcacaaacgattcctttccacgtgcaaggacttacagcactggaccatgatgacaaagaagcttggctttggttgtcaagactcactctccactcaagtagagcagctgcttccctctcatggttttcagcagtgatggcagcaaaggcaaaagaagtaaacttgaaaagttgggaggaatggaggcttaagagtgaacagagaattagacgaattaatgaaagcttagagaacatcatatttgagctattgggtgattatggaatagcagaagatgatggatcctcgatcagagctagtagatgatagtgtaatgaaatagcagaagatgatggatcctcgatcagaactagtagtctaatgaaatagcagaaaaaactgctcctgtttaatgtgaaagtacgtacctagcgtggcctcagaaaatacggattggatttattgggaaatttagaattattttttaataaaagtatttttcagaacttattatatacttttaataaaaaaattctccaaaccactaacttgtatataaaaagattcttaatcttattttaaactattagattaatttgatagttcagattttatcactttgttttgaaagatgttttttaatttgattactaatttaatttttatatcttgtatattttgaaatcataaaaatattgttgagggtgtagcttaaccactaactagtataaaattatttcaatttaatcaatagtcttttatattgtttagaaaattgtcagaaaatgtttgataaatataagactgttaaagatattactagcaacactgctataaaatatgacattttttttatccacaccattggtatgttttatcaaatgcaatcatgttgtgacagataaaattgttatagtttatagacaataaagttttttctcaaaatcatatgctaaattgaaagacctcgtaacaattaatccaaactcttagtagtattttttataggtttaaagtaaaaaaaatgttaaattaataactaaagtaaaaattaatttgttttaaaaatcttttaaaacaagccgtaaattttggatgataagattaatctaatggtcaaagtgacagtgacttttcctcctgtaatgttaatgcatgcaaataaataaataaaaaaacagttttggtccccacttgtaaattatagttatacattatgtttattagtcttttaaaaaagaaaaaagtgacattttttaatttgtataaatacaaattgaagaaaaaaaacattcatgtaaaatgttaacaaatatatttatgtaaataaaaattcttttgcagataaataaagatttgtgtaccatcaataaataagaaatcattcagtcaatttttttactcaaataatacaaaataaaaaataattacgtaaataataccccttcagattatttatacgtacttctagcaccattactgttcacttagagaacttgacctctcaaacccgatttctcacttgaattttatttatttattttattttgatgttgagaaattaattgggaaagtcattttatatatttattatttttttctggtttataaaaagaacaattcttgcctaaaagaagaccgattcattctaataaggtgtaaggtaaaaaatgaagtctgcactaatcaattttatgtcagctttcgtgatttagcgtccacttttggctaacattatactaagagtttcttgtatttgatattatcacagaatttggtgattaggaagataggattcacgatctcaaaattaggaaataaccgccatctagttcgagtttaaatcctattggcacctgaaaatgctcttttgaatggtttagtcatatgagatctctatgcagtcatctatgtaggagtacaaacatattccagctgctccaactgatattcaaatgcttgctattatcattttgtaattcaaattctgctgataaaatatgattatgtgaggacttgtttaaattcaaatctctttagtctttatttatttagttgtaacaaactctctgctgtactgttataaatacatatccctgataacctttgcaaatcaataaaactaagaaaaatctttcttggacacccattatgctacaagaaactcaaagagagaaaaaaaaaaaagaagaaaagtataggtattatatgatttatgatatgatagaaagagacaagataaataaaacatatggtgaaatgtttaaaataagtaaatatttgtatattattgttcacaacaaccagagcttatatggtaattctatattgtattagagcatatcttaatcaacctttttttttcttttttttttttccgacccacatggcctctcgaaccacctcttctaccacaactaacaatgcctgtaggctatgtagcacggatacggcaaaaaaagttttctcaacgtatcggacacccgtccgatacgggttcgcaagaaaaatgggattttacgtatcagaaggagaaggggtatttttgtaaataaaaaaaatcccaaaattggtgctctgcttcgatttgtgctacatagcttacctcttcgattttttttttgttcgtccattttgtgctcctccgccgctcccgccatagctgtcttccgcgtttgctgccgccgcgctgctcttcaatccactcttcaccgtgttcgctgccgccgcgctgctcctccgacacgcgactccttcgccacgctgctcctctgccgcgctcctccgccgtgctgtagctgctcttcctccttcgtcgtaagcccataacagcaagtgaagcttgtgaatttttttacctcatttttttcctcattcgctatagtctctagctgcttcattttattttacctcattaatttctaattaccacagctgcttataatttacatcatttatattaccattcaatttgtaactctctccctgttcaaatcattttattttagtagtttttttttctcagccctcaaattgtttgttattttaacatatctgtttttagcaatttaaaagcaaatattaatatttttaaatatgattatgttttgttaatttacatcatttacattctcctcaagttattttacattattttttctttctatttaaaagcaaatattatgtttttaaatatgattatattttgttttgttaacattatagaatgaagtcaaacataaatcattttttattagtagcactccatgtccacacattggttaagatatttatcaattttgtatgaataaaaatatagaatccctttttgcaattaccattaccatatttttatcaattttgtaagaaggagaagggcttacttattgctatcaatttccttttattatattttattaatatgaaatacactatatatataaaatattatttaatactaagacgtatcgggaacgtatcgaaatattagaatttttgaagaacgtatcgaagttccgtatcgagaacgtatcgaaaacgccgtatcggtatctgtgctacatagcctataggctcctctaactctaacatcattaagttcaaccttgcaccaacctgccaatcaaactttcagcagccatttatccgacatggcacaacttatgcacatcttgaaagccaacaagctggaaggagatgttacataaaccactccctgtcttccattcactattggatctggagactctgcggtcacaaatcctgaatatatgcattggtgtcaccaagatagccatttttcgcttgccttgctcggatcctgcagccccaaggctcaggttatcgtggcctcagccactaatctagaggtattctatgttcggaaccaaagtaactgaagatgaatgcatgactgcacgagataaaatagaaagaagagaaataaatggtgaaggcaaattgatagattggagcctaattaaaattgttcaatattatttagatatgggtctcaactctcaacaatgcctattagactttcaaagatacaggttccatacatgatagagtgtgcccattacaaacatagctccaatgcaacaaagttcaatacctcaaaatttttaacctacctattagtttagaaaaagtttcatacaacaggagtaggaaacacgcttatattacagcctaaaaacagaaaacgcaaacacactcaaatgacagtgataacataacaatgctgagagcaacttctaacttctaaggttacattacagcactacaacaggacaggttactctgtgcctgccatctgtccaagacaaattcccaaataattaaagtcaacgaacttggttgcacaagaaccttaatccccttcggccagtgagtattcacaacatacgtgcttggaagccctacatttgtaactgtacgagtaacattaatagtctttgagccaggatgatgcaccgtaattgaaggatagttgaaatcttcaattctgtaagaattggaacaactgtaaaggaatttcaaattggcaaacaacttgagtaaagcattgttgtaaccagaagcacataagaagttcaagtaatcggtggtgcgtaaatcgtaaacgagtccagggtcaattgcaaggttaggctgaatttgtccggcgccgtattcgaagggggttgctttcttatcaaatgcattccgagttggttgattcgtataatagtcatcctctctctctctctctctctctctctctctctctctcctctgtctttcattttcttccttttctctgtttctgtcattgatgaactagagaaacttcttaaacactcaaccgttgaccaaaacctttcacacccaacatgaaagttgaaaggaactactcaatgagctagatttcatcatcacttttctctgaaaatcatcaaacaaagagatccagttctctaggggaaattcacaaagtttgagtttggaagggaaagaaggcgattcaaggacgccaaagcttggagaagtgatcctccagccttcctcgactgtttagaggtaagaaacacaagttttaccgattgatttaggaatttgttcttggggtgaatagtgacccttttgtgatagggctagaattaggtttggattctttagaaaagtatgctcaggaggctgttctgatgaatattgaactttgaatcataactattgatgaagtttgattttgactctgagatatgtatgagtaggaagaatgttggttaaatggagggtattatgacatgtataagcctaggtgcttttacaaaatatgttcaggagaccatataaacggtgaaaaagtgttgaaataaccaatttgatgatattgataattgttgaaatatggtctggttaggtcatgaaattggtttatacagagttttagagtgactctagtgtttggtaagactgaaacagatcttgctgagggactgtgagtcgcctataaggtggatagttcagataaccttaagatagagaataaaaaggtgtaatggaaaggaatgacgtttcttttcattctaaacggttgagaaccattattgattggttgtttgtatgccttgtgtagggcgtaatacagacattgctggtggttgtgaccacgaagccgggagagccggtgtagcgctgagagcaggtaagctctttgttcttggtagtgtttcccattgtttgtgttccaccatactccgagggagtgatggttattgtatatcatgatgcatgtatattgaacttgtgtattactgttttatgataatatgtatatgatgagctgaacactgtgatagtgttatatatgtgattgatgagattctctggccagtagaattatgtttaatagactgtatataaaagtcctgatgtgagatgtgcccacatagttggatgaagcctcctcatgcaagaatgagagtcctgttgtgagatgtgcccacatagtagatgaagcctccatgtgagatgtgcccacatagtggatgaagcctcctcaggcattgatattattgtatatatatatgttatgtacatgtggtaatatggcttgatagctgtgattactagtttgaaatgtcaattttgatattatatgtcatggaagtgaaccagggggaggaaagacctccaaggaccctgagtttactgagatttttatctcaccccgtgtggggattatattgcaggtgtggcttatagccgtagtgatggataccatggtgggaagcccagtagagtcaagcattgtaagctgcttgggctagatattgagagttttggggctccctgtggtgtataccatattgagataggtggttctttttctcctgacatatctatatagatattgttgatgtctgccttgccttttgttatctggatcaataagggttagttgtagtggtgattcttctctatgattatgaatatgtaccatacataatgaatcaagaaatacggtttgaaaatgcttccgcagtttattaattaaagttttatggcgctattctgatataataataatgttaatacaccgggtgcacacggggtgttacaattcgtgttatctagtgttgtagctgaaataaataaaaagcatagttgttaattaataagccaccaatgtttttccaaatgatatgctacatacatatgatagtattttgtaattaagcatgcacatatattattatagctaataccaatgtacctgtggtcataattgctgatttgatagctcgactccaagtaggatttagtctctctttgtcattataggcactggcagatcctaggtacatgattgggggaagtgtcccccttaaattttcctattaaattatcaatatttttttatttttctattaaatacaaactagtctatgtgagtgtgttttttactggacatattatttttagtgctttatattacaaactaaattattgtgatttgtgaactgagatggaataattttagtgttttatttagtatttgtctgccgcaatttttagttttttagtgtttgatttagtactgtactattgtgctcaaatgagaaggtgactaagatgtagactagtagtacaaaatgaattgttttcattgttctatttaatctagaacaataatttggtctgactatttgtttgttcctttaaattattgtttataattgtttgttcctttaatttttttttacaaaaaaaaaaatttcttatgcagacataaataatttttcctgagttcaccactagtgtctcccttgattatttttctaaatccgcctctaataggcttagaaaaacaaaaggaaacaataattaataaaaaagaatggataaagaccggaaaacaaagggacataagtcaacttcttttgtgtgaatttttctttcatttgtgtcttaggtttctggctttagatgatttttctcttctctcttttttacaatcaaaactttacttaactatactttttttttatattggtgacacgctaagttcatattctcaatccatctttcaagtttttattatgtaattatacaaagaaaatacaactaatacactataaatcaactaattttagtatttattgaataaaaattcagaaaaaaaaaactaaatttatgtgtttaaataaaaaaaacattaaaaaagaatataactattatataattttaaaaaattattatgtaattcaaatgtataatttcaattattagtaccaatggtcataatagctgattttatagctgctggactccaagtaggatgatatgttttgagaagacccgtgatgccagctacatgaggccaaggcatagaagttccctgttgcacattgaaaagagatcgacgtctatctgatgcaatattagacggacctgctccttgtgttaaaagcagcaattatgttcacaacaggaacagttatgtctggctaaaaaaagaaacacattacggcaagtttatcttacatgagtcattaattgtaagaaggaaaatcatcatgtcatgttggtgtaacaaaatgtatgtagacctttagtatcaatggttgcacggaactgggacccctggatgagaatccagctattattggagctggctttactcctatatagctaacaacgactatgtttctggcaactgcatggaatgcccctatggatatcccatctgttaacaaagcttcagtatagggattagacgaaccgagagaggcagagatgaaatcaacaccatcatatatggcataatcaaatgcttgtagaatatctgcttcatggcaccctctggtatccagtttatgccagcacgctttgtaggccacaacgcgtgctcttggggagcctccctttgcagtaccatagtcgttagtccgttaccttcaacattatcaggaattggaccctctaattagttgttggtgtcaacatttgtcaaactcaacaaattcttaaaattggatggaatggtgccagagattcaaattttccaatctgtgcaactttccaagtgatctagtatttgtccatttaacaagttgccacaaagataatttattattgccaaattcaagttaattaattaacttgagcagtcgtccaagttgatttggaattggaccagttagactatttgctgcaagtttcaaatgttgaaggtttagcaaagatcccatttctgtgggaatgtagttagaaaattcattgtgactcaaagagagttcaaacaacagggtcaatttaccaaaactttgtggattttttccactaatattatttgaagagagttgaagttgttgtaatttgggtgcctggccgagctctggcggtttaccaccggataaattgttgctagacattttaaggcttgttagactatgacaattgacccaatttggtgaaatgttacatcaaaatctaactttactcgttcacaattttattcttttgttaaacatcctatttatgctttacggttcaattttaagtgagagtttgagataataatcacatgtttcaccggttgagaactaagagcagacttgttaattttcaatccaacaactctactattacttaataacattcaaatcggagacgaagtagtgctttacctgtttggaattaaggaggcatatgttgaagcaatgcatttgattagctgattattttgttttcagcttttatgaaggatttattttaaaaaaaaaataaagatgattgctttctttaaaaaagaaaaatcctaaaccagttagcttttatttgaatataatttttttgaaaaataaagaagtctccggtagcgtgtgaaaagtgtgcatcacatgccgtataaacaatttaacggcagttgctacacggataagatttttagggtgaattgctatccatataagaatcaattatcgacttcaatgaattaatattcatatactaagttttttttttatatattttttcatttttatagaaaatatagaaaacatattaaaaatacttttatttttaaacaattaaattaaaaagatatttacaattttttaaaaaagataaacaaaaaaaataaaatactaaatttaaaaaatgtaaaaatataaaatagaagtcgtacataattttacgacttctaaaaagaaaaaaaatcatataacttcaaagtcgtaattcttaaaacaatatttaacttaagttcgtaaaaaaaattataacttcaattttaaaagtaaaaaaaatacataattttaaaattgtaaattaaaaaaaaaattaaactgaagtcgtaaatttttttatgacttcagttaaaaaaattataagtcgtaacattaattatgatttctgattcaaaagtcgtaataactttatgacttatccctttagaaaaattatttgaaatccatctagaaatgataataaatgaaataaaatatctccaaataataaaaccctcgcccgcgagaacttgagttttctcaagcgttcggaacttgcattacaaggttccctccaaagatttagggacatgtttcagtgcaaataaataattaagagtgacatagttacatgttttatagtagaaaatctatcagaaaattgaatcaacattataattatttttattccttattattgaagactaatattataagatttacaacaattttactcaaatataactgagctagacccataataaattataactattggtataagttatggtggtgttatcatttatcaccacatgattgatgttattagttatcactaaattattaggaaattatagccatgtatttttttcaatttaataaatattatatgtgaagtaaatttagtactaatattattaattaatattcaaatatttattttaataatatttatatattaatataatgtttataatttaaaatatcattttcctaaatccatacgtgttttagtaggttttattgtaattggtttgtctagaaatatggatatccatatttgtcaccctcgaacatttcttgacatggtccgtggtctcgcttctatttgtctagatccaagctggctcaagtgcttgaagagcatatctttcgaaacaaatatgattccctcgtaagcattaatatctatggtttgattgttaagcgaaattgaatagatatattagtcaatgaagttaattaaatataaacttatggcttaaatatctcttcatttccggtatatatatatatattgcttttatggttttagtcgttaaaaaattgtttttttcaaaatgatttctatggaatttctttttattgattttgttccttgttatttttctttagttcttgtaatatatatatattttattttgcattttgaattagtctctttaaaagttatttgatagtgactaaaaacaaataatatagattttacaagaactataacaaaattacaaggacaaaaacaaaaaagaaaaagaattttacaagcgtcatttaaaaaaaaaacataagaaccaaaatatttaaacaaaaaaaaagcaatatgttagaagaatcaaaaacattttttgtctaaatttatttatttataatttacctacatttctataacatttatttcctgtaatataaatttattatgtttaattttacatttattcctcgcaacaatatttccttttattaacccttgtagtttaaatttaggtcctatagttatcattttttatgcttttggtcattgtcgtctaaaattacaacttaatgttgtttggaatgaacattaattaaatgggtcttgttatgttgatttcaaatggcattagtcgatatttgacagattaaaatgaaaaaaaattataactataaagacaaaatgagatattttaaattagagactattttttcattgtaactataaaaacatattagtaatgaaattattttattatttagaatttctcataaattacatttaaatttataattaagttgaaattattaattaatgtatatattaagttttgttattgttattttaaaatataatgattatgttgaacattacttaatcattttactatgtcaaaaaatattgaatcattttggaaatagtgtgtacattatttgtaataagaggttctttatattagcggataaattcagagcaaaccttaagtattaaattaagagggaggctctccaaatgtcaaactttgtcaaacagagttctataatgattaatgaaggcgtctattaaaaaagaaaagaaaaaaaaaaaaggcttctgtcacaattcccataatgcaaatccacaattgaaagtcaccaaagttgcacaactatcctaaggattaaactcttaacacttaacagggcttcaccagcttggtgaaacatcgcatccatatcatccctttgatcttccattatatctagctcaggcaataatatgatcttgtttattttggaacagggacgtgtaagtccgactcttctttgagttataatcgcaaattgcttctggtttgattagccagttaaggtctttgattttgtcccttccttttttggtataataccgttttggctgaaagttgtaagaccgtgttttcttgcggattttagtgttcttggggttttctcctgttttcacaaaaaaaaaaatattgcatctgatttagcctattttaatttttttggggggaattatttatcttaaaaaaatagagacaattgctttagaataaacatacaaaacatgcaagagaaaaacattaatatctcgaaaagcttaattacagtgtaaaccaaaaaactaaaaaacatacaacacaccagaaaacaagtttcaattatttagatagttgaccaagtgtgatcatggggagtggatccatagaagatgattttggcatcacaaactcgttatgcacttgttccatacttgggcgaaagcgtggattctcacttaagcaagcaaatgttaattttgcaatcaagatcacttcttcaacaattggcttcactggctgaggtagtcgctggtccaacacatgaattaatagcatattagacgaagatgatgaaaacaatgaagaaatgagatctcctggatgcattcccattattatttccaaacaaagcactccgaaactgaagacatcacatttctcattcacttccatagtataagcaagctctgtaattcatcaaaataataacaaaatagtattataaaacaagtagcaggacttattattgaaacaagtatatataggattaaattcttaagaacaaaaatggcctaacctggtgcagaatatccatatgtgcctgcaaacgctgttatattttgtgaatcaggattcagaattttagctgttccgaagtcagagatgcgggcttcataatccaaatctataagaacattcttgcttgatatgtcacggtgaacaataggaggaaagcaaccatgatgcatatggtacaaagcacttgccacacctttaacaaccttcaccctcctttcccaatcaaacattgttgcacgcgtatcatcggttagtactttatccaagctaccaccctctatgaactcataaaccaaaaaggagaagcgtggatgtaaacaatatccaagtgacttcacaatgttacggtgcttgatttcggccaaggctttaacctcagttgaaaaagcctttgaatcggttgtttcctcgttgggtgcagcatgaagttttttcacagcaacaatctgtcccgagggtaattttgccttatagacagatgcagttcccccttctccaatgagatatttgtcatcaaacccctctgtggctttaatgatatctccatacactatttttccatcataactccaaagggaataatgatccttggtttgatcttctttatccttctcctttttggcttttgttgctcttcggtagcaaatacaaaacgaaattccaaccatcaataataatagaaatagagcgccgaaagaaaggagtaatgccagcatgatgacatttcttttcattttatgatgaggtagggggtggcaaggcaccaaaccggaggcatttccacacaagcctttattatttttcaatgcatcaaatgaagcattaagaaaggctggaatgctaggaattaaaccctccaattggttgttagatatgtcaacattttgcaagctattcttaaaatcaggaatggctccagagagattgttgtgtgagaggtttagtgtttccaatctttgcaaagttgcaagttctgctggtatttttccattgaacaaattcctactaaggtcaagatcttgaagagattgcaattggttaaacgaaggaatgctttctgtgaatttgttgttgctcaagttcaagtgaactagtttgagtaaagatcccacctgttttggaattgggccacctaaattatttgctgcaagctccaaattttcgaggcgggacaaagcacctatttcagtaggaatgttcccaaaaagttcattgtcgcctattgatagatcaaacaaagaggtcaagttcccaagttcttttggaatatttcctgttagatgatttgaagacaagacaagttcctctaacatgggtgcccagcctagttctggtggtataccaccagataaattgttgttggatatcctaaggcttgtgagactaggacaccttgcccagtctggtgaaatgtggccataaaaattattgctactcagctcaacgaagtataactctggatacacaccaaaagcatctgagatatttccgctcaagcgatttcctgataggtttactctggtaagactcgagcaatttttcaggctttttggaactggaccggtgaaagaattaccattagcagcaaattttctcagtgacccatctatgcaaatttgttgtggcaaaggaccggtaaaacgatttgtagatagttgtaagctttggagtttggtaaagttattcagtgctggtggtaatgtaccatgaagtttgttattaaacactagtaaaaaattgagctttgtcaaatttccaagggaagaaggaataactccggaaacagtattcctagacaggtccagcgactctagattgatcaagtttccaatggaggtgggaacggatccagagatcatgttatcggataagaataccatgccgagctttgtcaagtttccaatatttgaaggaattgatcctgaaattctattactttcaaaatcaagaactttcaaattcaccaactctcctatgtagggtgggatggtaccagagagactattgtttgcgagcttaaggtgttctaaatttgtcaagtttctaattgatggaatggtaccagaaagtttattgcctgttaagtctagcaaagacaagctggccaacttcatcatggaaatggggatcgaaccatgaaaaagattagcatccattttcaactgagaaactctagacaagttagaaatttgctgaggaatgattccattaaaactgttgttactaatatccagagttagcagcttgggaaaagatgaaaatttgagactgtgaagagtaccttttagcccaagatttgccacatttatagcggtcacatagttggattcgtcacaaacgattcctttccacgtgcaaggacttacagcactggaccatgatgacaaagaagcttggctttggttgtcaagactcactctccactcaagtagagcagctgcttc
